United States Patent 7,332,310 (MUTANT OF HOMOSERINE DEHYDROGENASE FROM CORYNEBACTERIUM AND DNA ENCODING THEREOF) - sequence listing, part 4

SEQ ID NO: 5485 - protein, 503 aa, Corynebacterium glutamicum
MIDRPVWLFELYNTAKEVVYSLLIDEVTGENTILKKDDGWRDQFMIESFFAYDSEADATSWSGKNMNSYWFVSDLISNISFAERSLESFSWALRDLEDLSSSETGFEGLEELNLKFSELQEWYTNLELPFQPSAADVDEVEQYLQAEVTRQRGDYQWSPEFWIPKPDSYYIDHALAVVTDVLGAIEQGELREEVEVQQALDEVSENWNPLEDSDYYLQDHRGRPVQDLSREMEELVRCLMLDQEWWGAEARIRKLVESVEWEDTQAISSLIEHEQYWEDGRFRPPLHKFSEGLDEPEPLPMTRKMILATNHPDVLRVNIADYYQQHRRIATQKVECYKEVLALYPEILKKFDDSSFVNRHWIYRAFDREGQLLYIGETINPLVRLREHAGLGSINHAHHRLVSPWFSTMATFHLESCFTQAEAKEKEALYIKLEQPRYNKTHNSARLAVSEEGVPVNEVPSRNDPRNVGWKGHRHVPPMLPIVARVVDESTTREGYAFYEDNR

SEQ ID NO: 5486 - protein, 120 aa, Corynebacterium glutamicum
MVTLHLPYLKQRIRKQKIMSNLPTEVYLSNQNQNETILALKTWLSPSVAKVEYGGSSISVAKLLDNPYEALNIARHEEPKSWQTVARIHFDSSEEATVIVTMKGLGGTDRIRLTISQSES

SEQ ID NO: 5487 - protein, 74 aa, Corynebacterium glutamicum
MTKRNITTVRTEDGWGNRRDNASRLSKSFDTQSEAIAAAKVTAQREKLEHRIQGRDGKIREANSYGNDPHPPKG

SEQ ID NO: 5488 - protein, 104 aa, Corynebacterium glutamicum
MYLTGRLMSGWRRSGSVAILYQRDIPRILVKNSFSEKATETLMLIENFFASPDIDNPQVLEMLGEASKNFPKMYPADSSYWISEVGSKGAQEVLNDLETLLQSS

SEQ ID NO: 5489 - protein, 215 aa, Corynebacterium glutamicum
MNPERRLTSLTAFYFGRRVASAPHSDETIRSVCWPAYRDVQRTLWGMGSHPRAKELKATSCDKIVSFVHSFGGIRSQDEFDQQHQVWCEDLVAFFAENPHPERPTFQFHYGHAQKWLNMTLKYLSVLGHPAVEEVYVFLHAPIDRDVYERAWEILGVERPRIAWSKLDGDTYRSYQLNIRHAVAGQGRGFVLDWETDEWMEAKRFSRHSLSEGHS

SEQ ID NO: 5490 - protein, 253 aa, Corynebacterium glutamicum
MSRHNTIDEICIAFSGGTDRVLGIPFLFTSKKADFYITPSYSDGAQPIHLSLHDKTERHAEQRFHVKREKKPTDIKRLVFHNDIFKKGTPFRGKELSAGVFHVARLRYSWDLQRERFRETATIRLSQLKSDTCRVYIFDENLPEYSVVDFDIVLSNHDPFYFNQEDVFCQAQEQGSGSPYIELPRNKSGQFLTATVSVRSEIDSPTFDDVHLAAPLARDTPVLACAGATNTEGVYWLYNTVTSEEFIGAVKDG

SEQ ID NO: 5491 - protein, 183 aa, Corynebacterium glutamicum
MPINLESLLIGVSGGLLVAVFTAVLKYVDRYLDFRKEAKVNLKVARSEFRESQRLAVIRFLHAIERANHEHTIEMNRLDAEFREDLVKHAEGQSDNDFSTYVKFKMAVDELDLSLWAPIVRESLSEIKELLREIYNSAWRQKEMIDSGQKVRPATYINFPLLEQATNSILDSAIREFSESEPV

SEQ ID NO: 5492 - protein, 310 aa, Corynebacterium glutamicum
MLIVYLDEFGHVGPYISPKHKKYHENPVFGYGGFVIPEVEVRRFGGYFEHIKERLLAEEIRAANVHPRRWEKKGASLLTTKNYNKYGSEMIPALKRISRELKRSRGNVFFFGQEKPLGPVSISCESTQEREKHCLIQTIKRVGSIGASKDDEIMVIMDATEADNRTRAVSTLGSTIFSRHADKDLSRVVDIPLQADSHLYGTVQFADWICALLGRLCQYHFSESREFSWSVDLANYMFNSEIFTPNSFIWTNEHGNFKLSPQKMLQAEPYWEKRILAREKNKTKRQENKTMMSSVMEACSPEFKERYFLS

SEQ ID NO: 5493 - protein, 102 aa, Corynebacterium glutamicum
MFRVSITKDIASVGGLTENALPHLKTGVLRIEELVRSAFLYTGSSCPTIAIERCHRRGHTVHGVIRGFIKVLFFTLLFVFRIVEALQDIFCFETLLDNVHFT

SEQ ID NO: 5494 - protein, 119 aa, Corynebacterium glutamicum
MCISPKFSVMHLRSISVSPSLGQIASKATSPIAPTTWAIIALAKALASRSLLPNAPKLKPTEIKSVMTTAIVRRRHVLCRLCLSSMRAISASTSCSLSCTGCGSKTVAVTCPPPPQYSF

SEQ ID NO: 5495 - protein, 1488 aa, Corynebacterium glutamicum
MTATVLEPQPVQLSEQDVDAEIARMELKHNRHKTWRRRTMAVVMTLLISVGLSFGAFGNKEREANAFASAIIAQVVGAMGEVAFEAICPSDGDTEMLLKCITENLGEMHIIEKCLEAEDVLKCFYDAKNEEQRKEQNLDKAPDYSMYRMASAMASFYGNGRAATAGVEEGGPNEFLDSEDAGLKVWEGILSKAANGGNVLGYADAKHNEDSGWFFGNGVANNEKTYSYDSLADHAFQGPYHFALFGATLSGLGFDSSKAEDSQTDFAQRKGMGYAMMIAYIISGGIDLVFNTVLNILSTINPFRLLVGPVSQNTNKTFTENMAGGQTTEGTPFEGMTDFFGLIYNWSVTVGWLIVIPVSIGLFMMGALMFRRMDKGSAFKKVVIRVVYGVVGLPLLGVSYTGALDSFLDSGSSTSAGSNATKIVLSTYVDFQSWAENTRMRVPDKVTLAWSLEDQAPTGQSMRMVRNSALEINAQSNESFTTFKNPGSMDLGYSMDWMEKMADPANSGTDGTSSSSATTIFQGTIALLSRYIDNDSISSGSFETSIRSAMESLTSKEGSGEAVAGGDVMAWVTGYNTASGLNEITAAELADANNPLLEVSDSAGLQGRPIDRNAVSFKSGDATASCNNSVVTGSRAVVGDYRSDCNMSPLTMYNFLNTSFHPADASVFSTSTSASSYTRASHSAVSLIGSGAMNFVYWFSAMSLMGSFIVIGIGYAGAMLFNTIRRTLSLIGAVPFAAMGFIAGVAKVIVYTIAMLVEVIGTIILYQLITRFLMAVPALFEQPLADSLSSNESAELVAGAGMGLVGMALATSGNWAIAGMVITVASSMGVIIFTIIAMKVRGSLVSGVDEAVTSVINRFLDTQVSSAGATSGDGMMRRAAATGLGIGATHMVLNRDGDGGGSDSGSGGSGGGSDSGLGEKAAGLAKVVTTVAGAGLVGKYATDALDNYADGVINGDGDGAFAAGGDATVDGDYVADGDAIASADANADFVDGVVDGAGRASFSNAAYSSDGTTLDGEGASVDAQGNPLHADGTPMSAAEAEMKMAGLSSSGTMMEKSGVKSSGITTAADVMDDQSLASSVTESGLSKIPDTYGADVSGAAGTVGTTGADYSATDSSAGLNMSEAALQSGTPMGALAGGSVSSSDQAMNDAALQIAASQGLAPAGSIAGMEQLSAQATEAPAGKAGKQLGDLSGSALNTQLASMGQQVGDSVNSAYAAGGMGGVDVAGKVTEAAQHLSQVPGQIQNAVTNADAGSSGASFGQMAQGAAGIAGVAGVIGAAGAASSAAQGAGTVQGAMGNAAAGAGMINNAVSGGATGSTGAAHVVNASHGPVAPGQAHYQESGHAQAFVQNNQANTAHTANTRAPSSAQIMGANVAGSLASQAVRGIGQPGQMGANVRDAMGGSGRSGGRGGATQGGRGAQRSGVSAKNGIRAQRGQKPSVTGQAMNAAMRSAAVSGRMANMDGNSVGGTEADPQQGSGVTEKGDKGVK

SEQ ID NO: 5496 - protein, 193 aa, Corynebacterium glutamicum
MLKNKTLALLAVSTLMFGLSACSSDADGPDSSGASSSSTGSSSASADTTDSAAVDKDAQLDTFMRSAVADGSSAAVAVDNAVGKGFDKADAQAAAERLGDGFQFAADYQAVGYLESWYFGGARSEKLDEVRSDVIAHLSELGFTDLEAESSASRITLGDYCDGVPEYCELFFDGESPDLYDMGTELDSYKPTE

SEQ ID NO: 5497 - protein, 315 aa, Corynebacterium glutamicum
MIFSMTDSLLVSIRKGLIEERPLTELLRACIFLGSDTNSDSLQEWAKNELNGYGSIDGIPEYRKLKGPPVFAKIQAGNSIMSNMVLGPHNVPERARKYFPEELHFDQPIQTLIEWSTRQDGINLSPPNLLRVRDLHNDQYAPLNQILNLNVYLDNSYFSGIVDRIRTLMTSMIADLTHATPLDELPSSEKVNATVMKHIENNYETTITQANGAVAIGNSAKAVQKGLSVDDLLKIMQTINPEKFDLGEARAEAEESIQSIADELKKESPNKGFIQNAFEKLKELSIKAGDKAFTTMLNLVGKQIIENIPQLVSGG

SEQ ID NO: 5498 - protein, 57 aa, Corynebacterium glutamicum
MSINAFWTEVTTMQDEVDLVITNPPFSLFREFLSWLLHGDVLFSIIGNANVITYLGA

SEQ ID NO: 5499 - protein, 125 aa, Corynebacterium glutamicum
MLRKASITLMISVTLLTCASPAQALSSQALSSESSTSQSDSPTQFVASIAAPFNKNLTYEQRKAIRFGPTTEQEAEQCLAKYGRDGEGPWPAIAIYPDCSFDTIEQDFYDQAISKALSVISLGSS

SEQ ID NO: 5500 - protein, 607 aa, Corynebacterium glutamicum
MSTSKTEKTAVRKIGKMIDSCAHLEGFFSENDKTTFTDGHIDISNDASGAKRSFGGRVNVQIKGRKVNAKAADLNSYPVSVVDLRGFVTLAGLLFFVVDIDKKSNKKYPKYVLLKPFYIHDLLSKAKPGQKTISVRLKRLPSDEDRMEAIIALALASRQEKIVENPSNYLYENMESITVKSAEPLNRDKLAVYDGSSPDHSIIIRTGDGIEQFVNATVEIIPPNMQFHQANYNVSCNGVVYDNVLHRNIDDEHIELKIGKGITLRLQKLAIDAPGSVTVEFQDSLPERLKDIEFFLGVLQANTFFINEEPVVLKINSNRTVADLKDEAGVLRQLVEIANHFNIDPSLIRIGEITEKQFWQLDIVYRTAVKGEYVKNLEVKDETRLILQPFGRWNLALIAHPGDVAGEWTYHEVISKRHHFAMTPSTDRSDSSIERVTPYELIDNRWLPSVLNLHLDKLVDFYSALEETVDVDNLATWMVLRLIKAADSEQSRKTAFLIAAQALNDWLVERDREESPIYRLNGWQILYRQTGLLDSQRTEIRSFRHNLDQTMHPDNYSEIMIGCALLLDDREEANFLLTQLSVDRRAVFNEWPIAQLMTGALKEEIEK

SEQ ID NO: 5501 - protein, 67 aa, Corynebacterium glutamicum
MSMKSRRIMALRLTYQGDFIGLVVAEAEKPELLSMTFFDEIKSASWFDSVAKLMLSVRGSFVTHISS

SEQ ID NO: 5502 - protein, 156 aa, Corynebacterium glutamicum
MDIMSAHLPSHHDELVQHLVLADVKYRELSALSVKIEEPSDRPEFKLGVTVNDKSKDEEGVPRIIEVSLRVSIEVPDGKITVEPEAIYLIPENKVYLTESDAMVDYFNNHAIFTLVPYARQAVSDLGQRAFHTQILMPALGPGDLVFSKSTASREW

SEQ ID NO: 5503 - protein, 127 aa, Corynebacterium glutamicum
MRGYKVKLMTHSKKAMKAKAKALLASQREFLDSLVALRKKAGISQDEVANRMGVSQSAISQFEHYDANPTLSTIRRYALAVDASISYRVSSSATLYQEYESRTNNHVSVSGQEAAPPYVDWEKPILA

SEQ ID NO: 5504 - protein, 169 aa, Corynebacterium glutamicum
MVIKQSICSGGKPVHYHWRYNCSDNHIEETVEKIMDILKRKYVFNMLTEADAEALIEDRLELAERGRLTPEEHVKSISSQPQLDMFEIRWNDIFVRDQDPVSGIYSDGYSILMRLYYVEKSGCDWFLGLHAHEKEINTDDTITKHRQNTEIEIAVKLWDELSADGSPVD

SEQ ID NO: 5505 - protein, 279 aa, Corynebacterium glutamicum
MLVQSRTLVTAILSCSLVFGTTVNGASVAIAQENVPMAALYEPDYESLETRLGSINNDAGLPNSVSQTVENFAELPEGTRFVLDSDTFAVAVSDGVVTSRLDSQTGVIRHTFGGAGTISYNPGEVTRSYIDRVTVRVVYPDSSIDIVTPHSVVEVSDSFYYSVQSIDSQRVRNGQSIKVPMTVIAGDGAIGGVPQGAKVVRDRYGSVEDAELMGATIVIDEKTGELTFTAPEDRTGQMWFAAELIYPDGTYSEVHYLFEVTDKSVQDDSVPFFGSSLSS

SEQ ID NO: 5506 - protein, 314 aa, Corynebacterium glutamicum
MGNWAEITDEISKIYQDNQYKIRQINDVDAVSDKRREALQALFEHTGRNVIVYYSAWLENGRRFSGQSTDFSVNDTDKNSFMTALHKLDQSKGLDLILHTPGGDVAATESLVDYIHALFGQDFRVIVPQLAMSAGTMIALSSKEIVMGKHSSLGPIDPQFNGLPAHGLLEEFEQAKKEVSENPQTAHIWQVILNKYNPTMLGEAKKAIQWSNSMVKQWLEKGMFLDEPDKEEKATRAIKELADHSVTLAHNRHISVSKALELGLNIKELESDPKLQDLVLTLHHLSVIAAQRGPLIKFVVNHDNRGTFLQGHEN

SEQ ID NO: 5507 - protein, 208 aa, Corynebacterium glutamicum
MRGKQRVTLLPPTKTRCAGMDSVKTFHVSPLQCTVLLIAPFLAVTLTACADSAEHPVSQDLPSIITSTVTTTVSPEQNLDVNNDQSSVNDNDNQNLHVTSEGAGVLFLRLDNNVPSTDAANTTIEGKLISGPGGCLSVQPGGRPELLIFNTDTRFSDHPPQVTLGEKTIKIGERFSLNAIEVSSTDLTGIPDKCSNGAADRAWIVGTK

SEQ ID NO: 5508 - protein, 70 aa, Corynebacterium glutamicum
MGYLGIDRDNEEHNIHICTTADALYEAQVSVYEIHRVLAKFWNLTCHQIEEILDIVDEARRDRRALGVDI

SEQ ID NO: 5509 - protein, 178 aa, Corynebacterium glutamicum
MSMLSDMRMMPWLVLSVSVSMWGVASCASSDAPNSVSPLNDDESDVQWTTLTPSPLRESPDIDPERMALYELAYGLTQQELYRVRFEHGEIRQGMSQARRYLVQDRGVSLSDADGVLVDLNFTCTQVNESNDTDDLSVFCSTAIAGKDPSELRKELEAEFYFLPDGADDADDADDAMG

SEQ ID NO: 5510 - protein, 397 aa, Corynebacterium glutamicum
MVHTDRVSIHRAKNGVRRTRKHIKTICIKHPIGRSVQISHSPTALSDAENNAELTTAQILHIDPVTGVAIPRQNILLGEDFQTMASSFSQIRHGWGITQLIGQDPNRNQPIRSADTWTVTGSTGLTGFNTATHNTDDTDATAAYTMPASDPAVGLCALESNKDAPVDEFRDLSLSALRTATVMSSSGSAVITMHDPMVMSTTGALEARAYVDGEVINQHDLDSLRDQLGITTDSADTTPALPADPLAALGLSTPTTSALVPGLAELDCLNTDQARTWHDRDNSIGTGKPAILAVINAELADDYTLQILKNSTATPTDSTDSSDTAERFVAQLPAETAFVLIDPDIGAVTDLFFINSINQDLPAPTTQINSVAVDQRDPNIIYATFANDDRVYQLMLG

SEQ ID NO: 5511 - protein, 178 aa, Corynebacterium glutamicum
MAYLYGSADGMLNTDGFNMFPRASYTILGPMDADAVGVYQQLLNSTIPMDLARLVTTHNSGASYLRRGATNVVFETNLALGVNPYMKKRRATEAQRGKKRFKRDSHYGGGTVTTGTADLDVVAMQARAEHREERLGEKSTRKKEELAAVEAKELAAKKGPQTVEEGLAAVEKKHLAKR

SEQ ID NO: 5512 - protein, 196 aa, Corynebacterium glutamicum
MTFLHRSASFHPRTHDHLSELGLDPYKLSQDIPTVIYEVQPHSVFILKFNTADVRVYQEHSDLFVRHAVLVDPEQRKHEHDQLLKEILDLDAPRVNDDISGRTTVFLHDKTVVTHSGGPIAIIPHNPDVASAAASANKHKQSVMTTSRHPYAQMSLSDMLKQGFTLTPLEFPYCAVDDPDSSRHTMHVINVRDHTV

SEQ ID NO: 5513 - protein, 148 aa, Corynebacterium glutamicum
MTYFALVARNYAETGVSVEFHEVDDDADNSNGPNNTSNLPLKLLRDHSFDATVVYGDLVLHTSAHLRDTAIANSDNRPRVVTTAQKFFDYIRLATRHGAIHDMINNAPDTGTDIVVITATNDALISDESEYYDELFHILESAQGVILK

SEQ ID NO: 5514 - protein, 251 aa, Corynebacterium glutamicum
MSQSYSQMWSSAKQKGIPMLRKTVTGGIVALIATATLMNSVSSAEEVSGDVSAVDLAFAEFERTTAEDVANGVPEAIANAEKISNFTPSELEGFKSLLASDAVLRSVSGEEILPDNVEVVQTDNVGDEDPNVISPAAWQGSDYIEGCLTNTLYGIEVLKVCTGGTYYSNVGIATSVSNPRSYVKYNSAPGLAVTTSNPRGGIEGGLAAFYGDVNLVAFPNIPWVGPISSSAGTHRVVARSFPNSVVLNVYY

SEQ ID NO: 5515 - protein, 101 aa, Corynebacterium glutamicum
MLQMIETYDHYIVEKQGSKPQVNVANEINTSNNIPLPEMYSVFLLAFVVLVIATALLTAILEWRNSHSLPLATLWGLISCALPFAGPLFWIVISYFKNRKK

SEQ ID NO: 5516 - protein, 72 aa, Corynebacterium glutamicum
MITYFSAIDILSLLILSVIMLICSAPVLLVIFRSNSPDDLIAALILTALLGFLAVNFVLPTLADIGCTLCEL

SEQ ID NO: 5517 - protein, 103 aa, Corynebacterium glutamicum
MSAKSPTPQPPYEIPSFRKRRLITTGLLTITTLWFIYFYVDLVSATTLLTLPVIIAAPLIMVYIWYHEFTYYARVRKNNKLYKALYGHLQNHQHPENTDTPPM

SEQ ID NO: 5518 - protein, 295 aa, Corynebacterium glutamicum
MTVMAQASTTPSTQKTPRLKTLNRGVAHISKKKGPTIMLYYLAAAVDTTPRDTMTMGEVFIMTCLTFIVIISFFGMVYAIARLIEHLIYQQWRSFMTSACWLIISSVVSLISYGIALNKSDNNEPMVSTTEPTPPPTNTPPENNTSTEPMDWSIIINVLAVATVVILTLIIAAALYRGFTRNKIKKLEAIREAQQHERDNPTIRIADLRGIMDTHHYIYTDVMVTRAHELMITAPAFFDVTLPEAVLYEDTKRAAHDALNGYKDTTVASAEKIMLVDAVTAAWTLYSTKANTGST

SEQ ID NO: 5519 - protein, 276 aa, Corynebacterium glutamicum
MLVRSRTLVTAALSCSLLFGATVNGTGVAIAYENVSMAAQYEPRYESLETRLGSSGVFPKSVEQSVENLAELPEETRFLLEGDSFSIIIDDGLLASRLDPNTGEIRHTLGASGISYTPGEMKRSYTDRVTVKVVYPDGSFDRVTPHSVVYVADSIYYGIESTGYPKVRNGQTVKIPLRVTDGGTGAVGGVPQGSKVVRDRYGSIENAELMGAIILIDEKTGDLTFTAPDDRTGQLWFRTEVTFPDGSDSEVQYVIEVTDQPEPVDVIRPAGSSLSS

SEQ ID NO: 5520 - protein, 99 aa, Corynebacterium glutamicum
MRVMDGTGVIGGVPQGSKVVRDRYGSIDNAELMGAIVVIDEKTGELTFTAREDRTGQLWFAAELIYPDGTYATASYSIEVTDQPEPVDDIRPVGSSLSS

SEQ ID NO: 5521 - protein, 127 aa, Corynebacterium glutamicum
MMKERRIKTLAALVICGLTVSGCGNYLGDINVKGRAGFSVSEAGDLIVRVQPCGLPIDTVDMAGPMPQDQPPQANPVYLQLSDPDGRTDPFIVDPENLDPSWAIIAGDGLPLALHIDISVGSIFLSS

SEQ ID NO: 5522 - protein, 143 aa, Corynebacterium glutamicum
MYSDKLILLFLSEQDSSYECCVGLLDGSDGRDYIEKLLKGRKLKNHFLEWEDINKADVAREEIYKGQLVHLVFVTALSTPGEISFVFPGQSLMSATLEEDFAALVLEEERTSFRPELSHLWSLPVGWVAPGLEGFVERNSEAA

SEQ ID NO: 5523 - protein, 527 aa, Corynebacterium glutamicum
MKLFSKAAGVIAAALLVAGGIAPVAQGQASQVVTPEDQDAYVQQFHHEGNTPPVVDGVGGYTEQEIAEIHEAIRQAQESGAPNEELIPGEMWSDKVELPVTIDKAAADEAEIAIAQQQSQPQTRGLAAAAACQTFWPSPHQVCGAILERYIQQGAQFGWMLFPSEGQTLNPDGQGYRQRFMNGFVYWHPTTGAHAVNNYSAQVWERNGWESGWMGYPTGGEVPVNGSNPIDGELSGWVQTFQGGRVYRSPVLDGFQVASINGLILDKWLELGGPDSDLGFPIADEAVTADGVGRFSVFQNGVVYWHPQHGAHPILGDIYSIWREEGAESGEFGYPIGDPEKYTENMANQVFEKGELAANLYPNPLEAFIEFLPFANLEEAIEYFENGLSNSRVEANSLNAKKDSIQCQSQSANIHVRTKSDGVGIRVPKIGFKARMDCDLPGTVSDVVGYGWIYYDYWGRWAQAAYAQQFFGNRNSVVQTNLEAGCSGEKNTLFWGTSYFQVTYEGQPYFGQSATNYAYLPCTIDRS

SEQ ID NO: 5524 - protein, 810 aa, Corynebacterium glutamicum
MKLFNKLKNKRAQEPAASLTTEAEETTTTAVEAPLPAPSLGARIIGRTSESDPIPPVPARTARTLSGSFGFGEFDDRATDTDAHDVEEISDELDDETMTRQQKKDAQAALGTMENHGHLMVIKPREHYVFHSDYFEVDDEIGTILSFFHNEDAKDEFGAFWGVNRIPRNLPEGVSAVLFEQVERMKQSWIDDNLKNTDRLAKTEESDLADSSTKSNRRKTVKRGLDLDEVIAELDDGASYLTVHNRLLLRGPNLEILDSTVEKIRRSFIEHLSRMDIAAHHGEQRQELSQIFGKNSKKRGKGFHFTSTEFAGSYSLVTNGLNDVAGEYVGVMRGDVNNSAVLFDVDRWSGHVVCADSSINTSPLLKRPRVVDMWGSKISQAALLNNRRVVHLVLNGAKLDEMGPKLESMTAHVDMTSGDLNMFELFGKQEDELSLYSTHMDKIVFMTEQALGDKTSELALLRGKLKEIITAFYVDMKMWALNAGENRDKLRLVGVPHEQIPLLSVFVSYLDQEYERQKYEGTKDPEMFRAISVLRLTYKDLLDTHGDLFNQHTADGIDSVNSARRVIYDFSGVLRRGAGVAMAQLVNVIGFAVETLGQGDVVIIHGADGIVDVDVQDYLANQFAYMAERGGRVAYLYSSMDAMLGTVGFNQFQRAAYTILGPMNVDSVDTYQSLINSQIPMDLARLVTTQNSGASYLRRGSTNVVFETNLALGVNPYMEQRRKIEAQRGQRRSKRDKHYGGGTTMVGTADLDVVAIQAKAEHREERFDEKSARKMKELDDVEAKELALKTGPKNLDDALAQVEKKRLAKR

SEQ ID NO: 5525 - protein, 289 aa, Corynebacterium glutamicum
MAKAEYKVPPSLARSVLDYETPITTKSFSLGVIPVKVLLFWFVVFISTAAVIMTPPVKHSPVWLKIIIVLWVIGFAAYFGQWTKTKEMKFMQLPALFGYLQKQHRRISTRRDTAPYPFMQLVGIKSVDEDGYVRYLDGSVGYFYSVVGTASALLFSGDRGQIVDRVDSFWQKVETDTQWNFITTKESQAVFSQVANVERKNQNLVYRHPELTKLMEESLDILRYDVGGKFSSIHQYLTLHSPNDAALHTAQEILLSEVENSSAMYKQCRQLNGFEVNDLLRSIYGHKKK

SEQ ID NO: 5526 - protein, 759 aa, Corynebacterium glutamicum
MTIGILTEKASAAKNFAKALGGPSGTYNGEKYVIAAASGHLYEFVEPEEMVPPSYADKIGGYWDLAKLPWDETQFLWSREQKHGAANTIARIKKTLSSCTTIVIGSDIDPTGEGDLLAWEIIAELGLDTKKIQRMEFVDEAPASIQQAFINRRDVTSMHDEPNYLKAEFRSRFDLLSMQWTRGATKVLETTGRRAVLRNGRLKSAMVAIVGQGLDAYNDYKKIPFYQNRFIDDHGVSYVNPEEPRYKTCDEVPQLYKASAVECYEKSMKKTAPPRLLDLASLSALLSKEGFSAKNVLKTYQQMYEAQVVSYPRTEDKTITPEQFKELAPLVDKIAGLVGVNPADLTHRQPRSTHVKPKGAHGANRPGLNVPTSIAAVKTTYGVLGQRIYEVLAKSYLTMLAEDYLYEHQKGRVVDYPAFLGTANVPKSLGWKGIFDVDAEADDDAAGSDAAQQGIGTRAEPEVFEGFPQRPPHPSMTWLMKQLDKHDVGTGATRTSTYAEVTAGKSALLKETRGKVTMTDAGQLNYLLLPGTHIGDLKLTERVYADMAAVAAGEKTAEQALEPVKQWVEEDIATMTRNAKNIPQELGKKLMTTTFTPSVKHSGTWNGEQVSFKKVYCGHEFSDAECEALLRGEELTITDAMIGGQITTVTGKLAHQSFNKDGKTIKFFGFKGQVDRIASADPAVYAVGVWKVEGEKIRFKRVWGGHKFTDKEIADLLEGREIAFDAMSKAKKPYTARGSLQRGEYNGNSFVGFQLAPRD

SEQ ID NO: 5527 - protein, 695 aa, Corynebacterium glutamicum
MINMMSLGNPAAMLAAYNTSTQVAPQPQLGPRAGEVQLSSEQQAMIDYVLAGKDVIVDATVGSGKTTAIQRLCSIMGADHDVLYLTYSKLLKVDAQQRVRGAKVQNYHGIVYPHLLKAGIKCGISESIREFNKNFKHISRTFPSYDLLVIDEYQDINEDYAELLRNIKSVNPLMQIVMVGDLEQKVRSDTTLDPQEFAAQLCEDPVFAPFTQSFRIGEAMAAGLADAWNKPIVGANTAQQIEYRSFAEAVVLIQSTEPSKLLCLGSRNGQMSDALNVVERKSPAKFNKKTVFASIRDGDSQIAHPNDAAVFTTFDSSKGLERDTCVVFDYDEEFWDMRLGYPNVDPVVMRNVFLVAASRGKNKVVFVRSDSLQAAYEAGADWAAGLAVGVVDNNTEVAPEVDAHTPAEESKGDVGEVQSQIERMMGFIPVSVFKELPELAPSEYARPISVTEAFDFKYAENVEACFDLLDVKRLDNGKGAAIEVNRSDGLIDLSPTVGNFQEAVFFKDYNVHTALSAYPSQFAKNLKRLVKKNNSVWRNCLIVTAASTEQMRYVDQVRSSIPVAAEKALVSRLSTRLNADSRNQIPLILDGEAVQSKVVRTPMSFAGVADAVHKGVLYELKFVSELTHPMFLQLAMYLVMSGMKDGILWNTRTDEAWQVRVPDPKRFLNAVVLCVSKQDYRVGNFDLPSTGGGAR

SEQ ID NO: 5528 - protein, 297 aa, Corynebacterium glutamicum
MNKTDEAFLLEGDIFAPLIAGLSSDNSAIRSATVQHAFRSMDRAAATGTTYGASIVQSLCDIVVTHMFVESDFPRKYGWSEITVGRQIFEQLGRRLGRASDESPERFEAQAVPSTHVFHAPLDKTPSFEVEVSLRLYALETDSVSVSECCFSGANFSECSWHYARLTNCDLSYCNFIGAQLGDTVISGDLSHSRFREAVMSCAEISADITNAFFGNVDLQASRCVFNKATGASFYACSLKGADLHGSDNAIDLSDAVVDYETVFPDGSTLERKHYDDYQNISTKWGEVLFVANRYQP

SEQ ID NO: 5529 - protein, 144 aa, Corynebacterium glutamicum
MGFSALEMWSTELGITVSVAPEPQNSDYESGLAQVEGHEWHVRTGRNTPSKPGAFVAFWQRGVGGQTQPFSDDGMNAGLLVFVRNDVRRGLFRFSAGHLAELGITAADGQPGKRGFRVYPSWCEGLNSQARAMQRAQSSAFEEY

SEQ ID NO: 5530 - protein, 248 aa, Corynebacterium glutamicum
MTEPHQLCIYTRGYKTSGFRFIGPSLSLDFLLINIMGKWNAFSRVTKRDGSSLPFPGNVFTNQRIAGAVRQCLFQAIVAEKWSLFSSNIRSLVADLPDVLTVSELQEWLEFFVQHTGIDVKVGRALIVDPDQEWAQSAGRCELVGYCALSPGSPSPISSVFEKTDLELWESALATSWMMLGPSTAERYAYQMPVEEFYWSHDAELRWWESFVNGCFDDLTSLQKLLSLLLAKHYLSRDYLMVRVFKID

SEQ ID NO: 5531 - protein, 629 aa, Corynebacterium glutamicum
MVRRLVGVSAVMLLAIGVASPVAQAQVEDQFELVKEISDEQFADDGVDYVPNRNAPTVKEQLEDFESAHPEVVIEYHEHVNDSKDNVEELPLPKRDIVAGEMRSDVIELPEGVSKDEADQVEVAEARLNEGARLMAATGCEAMWPTGFSVCGRILDAYRQVGGQLSWLGPPKSNELTNPDGVGKRSEFVGGAIYWHPDTGAYAVTLDGLRQWGTLNWESGPLGYPTSGPMDTNYPLTQRQTFQGGDNYYNPLTGGAVWGDIKQRYEELGGSNHAIGIPITNELPSGTEYFYNNFSNGTISWRNDRQTRFMYLATQRVWDALGRETGRLGFPEADETPEVSGLFHVVNFAERGVIAWNGILGARELYGDVYSLWLQYQNTDTPLGWPIPSLTSLNESLEQEFTRGVVLGSGDALTWIPDDEERSLEDFLPIGSSGSSSSSQEMTLFSQRAQYVDCKNLPDLDEQRKTENNIEKNGGPIKKEYSSRGFPTEFRFVVRKGHYDRYRNEGWGYLKNYCKHNFANHAMAEAVVDKAVIDYGSSPGTSYYKFEKTVYFLDCRTYTFNKNSGCKEMHAPQWVTIIYNPHTFTGANSNRPKGVISAWCNSTPPGGIEHEPEISQCPDHVNLYNKLRI

SEQ ID NO: 5532 - protein, 97 aa, Corynebacterium glutamicum
MAQTRTAGEIIKDQQKQIHNLAAEVKRLRERDDARDQQLGVLNEAMFSLLGDGLDRFRESGDEASFNAALNYQAVVAPEMFKTVYGVDPSTGEPIPT

SEQ ID NO: 5533 - protein, 410 aa, Corynebacterium glutamicum
MVVIMTKAVTPIVVTDGVRFDEVDLVAGNARLHSVLSQLWDKLSLGSDKLRNLLLGDSTHPAYGRSWVTLTESINKGVAAGTVTRAQEQLFQQMLGLRDIYQGVTDAQTWLGQSAVSGGERVQSEIKVVTEVAQAPVLHEAVAESAEVTQGAPAVEVVADLDAAKEHQLAQEPKRSGKKSVKQAPRRQRSARTTTDAAACTPRAGVVAFKSSITLRDGDGVDLEDELRTVHRTSARLTDLLQDHVHKKLAQQGVTFRGPIPFGILVNLGIVSLLANHEDVQGLVSLSDDDQLVLDILNEHRSVGWQESVNDALDEQAQQMAQINKTLGFLHKRSVQNERDNFFFEHLLSAFFAERLMIGDIATGSAVEDIDLHSEKHEKVLAVLKKSSEHEWQRGKDVAGRQFHAVRNDD

SEQ ID NO: 5534 - protein, 392 aa, Corynebacterium glutamicum
MNEQEREALEDAALEEAALADELAALEAEAGVQGSVEPYDYAADLDDEDEFDEDPFAQDEPRDAGPLGELSSDNHVSEAVAEDTGTSTEESAQEGSHEESVDNPRDFTGTATAVRSFRPRLPVPNALRPGPPIRTQPAVNTDIDDGGQENTAGATAADVGAGVFFGTHFELAFGQVDVHRHIRHEQAMRDGHQDLSVFVGADGAIMLEELKNRYQRPPENEPHDDDVTEMIKTTEETEKENVEMDQDIAVVDNVDEQVVVTPAHDADSVAVVAEQVVASEPTPEPVPKVEHVEMSVDLAGETITPIDQAIRSFMQLNGIEHSVVLRRLGLMTQVAHNKELDEVYAKALAEGESHAQQQHELEAENERLKKEVDALAAELSAALMGEGGGDHD

SEQ ID NO: 5535 - protein, 119 aa, Corynebacterium glutamicum
MDFRRIGIDMADEKKVHVRATLRFDSDTHQRAIYWADRKGISLSAYAEEAIREKIDRDNGVHVIPNSLLDNRMNQIIDQLSSFGRELANNTTVVTSGFNTIIGMTRGDSYLSDDLDDLG

SEQ ID NO: 5536 - protein, 228 aa, Corynebacterium glutamicum
MINLSTTQTSTRKFPRMSLSISFHKIALSATTLLGAVAISACALVTQAPPINAAPVTGSSSLSSTLDLGTTTPTSIDTVKLTQQAQNQAAPRVAASLVRVVDGDTIVVNYQGAQKTVRMIGIDSPETKHPTKPVGFYGPESSQNLTTMLRGATITLEFDSTQAREDQYGRLLAYVWYTKGDSGLKLANLEQIASGSAAEYSFDTRYNHRNIFLRAQTLAKASSLGMWG

SEQ ID NO: 5537 - protein, 49 aa, Corynebacterium glutamicum
MVMMLSAVLEGLLSASAISQVLGFGDLLDLGGLISTELGVEGYGEAFSA

SEQ ID NO: 5538 - protein, 188 aa, Corynebacterium glutamicum
MSYSLIISKAPTHSMPFNEAELLELVDELHSDNTVKKPVIVPLPDDFSYTVDSAVRLHDLGVDQELTDWITAQVAAAYPNQIVSEIAAAPDPQAKTLFSANAYNTRSFGTFWTEHPITQLQYKRCYQIVIENVTGVYHPLPVDNYRYVPPVTPSLPQPVYHEAIALNESDVADHGTRAAKHAMINRNV

SEQ ID NO: 5539 - protein, 484 aa, Corynebacterium glutamicum
MTHTDTPAPAHGVTPSEFAVTSHELTTSPTPSPTQVAIAAQEKIRQRKLEELKAKKRTDTTAQPLLPAPVLHTRPLPSPNPPRPSPPAPTTGHWELLIVRSQQKKMTAANPFLKFLHLGKAFNVKDLGLTCDRTTDVDLSRLGKLNPPSSLILELATALDLHPFLSVALSSHSAVNARRNQLELTLHNHDTQGTALGHSVTMVQLPEVINRAAVEPYIKPKGSGNDPLDQSLNHRAPTVSDVQKALVQENTGTATDSNNYLLPFDPDSGAPKTTALNAPNKDLLQARHELAYIPEIPAIASWLDHLDPIMRVHRSLALSIFPVQLLRAAVENLPHNVTDLHNHLDPEDLLPEELTTWLDHLFDADLTALASCPQLAPPIVRSHNHAKAIAAITVTSVMDALIAKTLDAHDDPLPSLPEFVELLRDAVAQLAAHFKQQRGEVLPQPNGLRYATDFGLLSYIADGLHEYALAIDFGLIYPNELITE

SEQ ID NO: 5540 - protein, 153 aa, Corynebacterium glutamicum
MSRIITAPVHKPYIIAREVKGVSHVHDTVGGKWQATLHTLKPGPSWPKPSQFTAPKSTSIWFIAVATHPRNPRARKGTLLGRGGLYELKDTDLNFLTERQDLLATSTSRDPEDCRLRFNSRHDAAAFLHANARHINKLFHPALGHARYDLIDV

SEQ ID NO: 5541 - protein, 407 aa, Corynebacterium glutamicum
MWGSCNNYPTISAGLPYITAKLVRVFFMMLYQHTTRGLIISDAIIAKISQVNQLLLLRPTLLQDKDMHHATLSSDTPSIRSRRRSYRENKAAYATTSTIRNRETFFSTSDIDFAILMIQDVQESLVSFDPTLAQDMKPRTNAVISALNELREPLDTFYRAHEYGDIISDGAYEFDHAAIDAQHSLSELVAGLHNYDNLMFPQETAPLMSESNGIQLAQYYKSTKLDESQLTVEPNEPGISIMWHAHDFTWSCLVRYDDMNRYPEHFSISFKDMLIPEQIYTFHFTPREAMQLRKVLFNAIAAYKSQTWGDENTDLTKAELEFGGTSMTFRAGLSQLSVTGPPDHRQVFCLSSSGREDHNTPPNMRDGHVIDIAVTQLSTLRNLIRVLCTTHPDHSPALLPYGQQYTI

SEQ ID NO: 5542 - protein, 473 aa, Corynebacterium glutamicum
MRYTPRTHRALGLAALTATALLLSSCSTTADLLGADSVAQAVTDGGSALDPTAAHVLTITNATAMTLAELPENTDPDAANNTEPTMAQSALKRIYGLEIAADGTLIAVAAPLTSRNSGSEQPTVAAMADPENNAELTTAHILEIDPATGTATPRQDIALTEDFQTMASSFSQIRNGWGTTQLIGQHPDDPKQPIRSADTWTVTGSTQITGFNTNTPTGTEDAAYTMPATEPAVGLCALESGSDAPLDEHRELSTSALRTASVLSSSGSATLKLHDPMVMSATGIVQARAYVDGEVINQHEIGDLREQLGINIEESEAAQAESDAQAATDHPLAALGLSNPTSSALVPGLAELDCLSADQAATWHNRDTSIGTGKPSVLAVINAEMADDFTLQLLSSGATTAETQLAQLPDETAFVLIDPSSGAVTDLFFIQSLNTDLPAPTTQINSIAVDERDPNIIYATFSGDDHLYQMMLG

SEQ ID NO: 5543 - protein, 197 aa, Corynebacterium glutamicum
MTFLHPKAAFYPLTMDHLTDLGLDPEQLINELPTITYDVQPHNVFVLQFSTADVRVYQEGNTLFIRSAELINPELRQRQRTQLNDDLNNPASLRVCDEISGRSTVFLKDKSVVTHDHGPIAVIPHNPDEASAKAVATKHKHTLSGATSDHPYAGMTLKDMIEQGFTLTPLEFPLCAVDDPTDSDRTMHVINVREHSM

SEQ ID NO: 5544 - protein, 132 aa, Corynebacterium glutamicum
MTTFALIASPNNVDPTAESPLAIEIHTDEDSSYPLGLIDSDHLVPAVIYGDMVIYTKTLLAQTPPDDVSTASAFFDKLTALDAQGRTRDLVYSATYSQLVIAGHNRTVLTDDSEFYDEFYQVIEAAPGVILK

SEQ ID NO: 5545 - protein, 79 aa, Corynebacterium glutamicum
MINLFAAALPAFEPLSITSILVLGAVALICGLPVFLALEKSAELDDLFAALIIAVLLGFAAYTFVLPKLVELGCTICQL

SEQ ID NO: 5546 - protein, 208 aa, Corynebacterium glutamicum
MSANPSNNFNVIGRLAADPKIFTNPDGSRNIQIAVYSTNNFANRNGVYEDSIVPLTQFYSASKEGNGIYSYLKEGDQVAVNGYIHQDQFTDKSTGAKRYELNLSIDSIQPLETKSAADARRARKQVVEANKAQAAAQQAPAPVQQFAAQDAPQYAGNPFAGLSQTQAPVAAQVAPQPQYVNDPYAQPQAGFVPPAPVAPQVDIDPRFI

SEQ ID NO: 5547 - protein, 193 aa, Corynebacterium glutamicum
MSTTTINIIITNGAAPHPTNLNRAEIHDHLPLTASDSELTRPSQESVLYDHESETVLRTMVIPADLHVAMKHLAKKHNLTVTEISRILLQRYIDRNINHVEQNQAESDMVEVFASQPTNATAMIPVPGTSFRQIFIKHSTGFWKNIDHDLVDLDASKTPRVRDRSVLPQPQLHRALLSDADMARLAAQLTDKH

SEQ ID NO: 5548 - protein, 154 aa, Corynebacterium glutamicum
MTTRTVSTSAPHVTVNINTAHNKTRTVTNGARKTNAERGKSCISFRVGPELFDEFKATCIDNDISMTKAFEKELRTWVDEHNAGATKKRNTHRTYVQAPVGTVATSSIPGLGLFTVFKKSSDQMWYDLESSPLIAQEPMSNMDMHRNGSFELHL

SEQ ID NO: 5549 - protein, 169 aa, Corynebacterium glutamicum
MSKKRDHLTVIPDLESRTHHSRSTQPPTTLPAPQLTIITAPDKHQPQLRVVKNTTTPSSVQPSPINYSFTDPVLREAHYAFQHSELARPTVLDSHWVRRAQEEFDTEHNAAYVRAADQLLSPFDAYMLDNGDVYTKTPRAISAAEQEEILEHLHEHHICWDEEAEFLLR

SEQ ID NO: 5550 - protein, 196 aa, Corynebacterium glutamicum
MTILVQESTPMPHDVYDVEHIISKQPFCSIFFQLPAAALKPTIQKAATNRDLTKLNTEQIAENLQRYLDTYSVMSHQRVTIEEVTHVRNPHEPDYEFSPQYGAHISLIGESYAVNTATNEPYATDSEGHPLALYFEMSLAPELHGVIHKFFPGFNLGGEYLPADSRDIYTELNDLLDSDDLVGTDITIQIDRANKD

SEQ ID NO: 5551 - protein, 111 aa, Corynebacterium glutamicum
MGCFAMPQHFSQENYRKAPVIMSAPLTIHDLLSTNSKLNLKWLTCTVLNSPNLTEPCITVSVNHTEGMSLVSFEGGHGLTEIANTQLVPVLELPKFNPFEALAIHLEAANN

SEQ ID NO: 5552 - protein, 186 aa, Corynebacterium glutamicum
MSYQSSILLRHLLSTLKPPTTKKASFMTDNADNTTDNVTNNSDTNLDYSFDPLPDEPYAYGFELVAADAHSDSTTTSTDTPETVAVALKTREDTINWVNTQRAEGKPDEIRINNPIRSERIAEFVHEMIMHHGLVACMEDLAILIKRDKLTQLEAENAITAWHNLTKESLGQIMGLFYQYVENNTK

SEQ ID NO: 5553 - protein, 190 aa, Corynebacterium glutamicum
MSDNTQDNPFSIRYAHPDHQLALNELVDTADLPAPTSYMKNPWSGDNTPIAEWRRERITQWQRTEIIVNQRDDDDLIHVSFPKLGQHIQLNTDDILALVAACVTPTANDIEATIEENLHSYPHDTVIMFNADDLDDALGLVVAVKDASGEHSPRAVWRTNTDHGALDETELARLILKFGGSFDDYGVLQH

SEQ ID NO: 5554 - protein, 304 aa, Corynebacterium glutamicum
MKNRKKIMSTLTTVCAVLGIVAAHPFHASAVIGGSVPSTDSVANAVAKIGPGALNCSGVMISPSWALTARHCVDDINILGDIDTITPITPGIHRNEGNYMGEVYRAPSGDLALININGVHKGTIAQLPTQEYPLGTAAQSVGFGGGGVNIRTAESVNMILTDIYSVRSGKFHHGVGRSHYLLFDYDSAETGRIHKGDSGGPIFIGDEVVGIMSHGTINKNDGSFDDESGADVFASLEWILDTTGITVTDTAEDNNDNSDNDDVDSKEGPASNTSLVLTDNGPSRIGSNTSSALIGLSSEALFSS

SEQ ID NO: 5555 - protein, 231 aa, Corynebacterium glutamicum
MSNNALLVANEADIGLYLHWNGGRDSIEAFLAYAAYAQLPPINENNDWLPPFITVLKNFFGNDGSGVYLEPVNQDYLDGIDYDNGVYMLDDYEITERINPPAVEQDSHDLHDMLIKIDKAQPPVDQLGSFLHGLETSVADLGVGDRVFLPRFSTFDKKLGRYRIHTVLGFAENDPFNPMTSSERFKGKPYVDMFDNQDNAFNPNSYITTDTVRIVVDPVPETNPDDEKAGR

SEQ ID NO: 5556 - protein, 122 aa, Corynebacterium glutamicum
MSRSYPIYIISFAPADDLHGVGGFEWVPASTPENKAAAFTTFDRQFDDSRNNGGSHIVRLLNISDPNITADMTQDDITAYLDSNIDRWESTEHALKQFVPLNAGADRVPTGGADEHITHACR

SEQ ID NO: 5557 - protein, 249 aa, Corynebacterium glutamicum
MDASQHHNTAPSAINARGVFFIPTTPFFSRKRLDTMPHNPIELHTNDVLDALDIDAICDDVFLYTDFEHTPGQLDRFEQLAFTKIYDMLETAAEKFPDVAINDTLSTGNHAAEQYFLANPGNIIVLTSFALNQTDLRDLIISPCIKYTAHARALMRAVTRTLCTANNPVERATIFPVSVANALSIEALCSEYHAFRTKQVLNTAALINPDNTLIPMLLSKAYEAYAWHKGVESAQRGSNLAREYYAGLI

SEQ ID NO: 5558 - protein, 60 aa, Corynebacterium glutamicum
MVLGCIHSAGESVCSYAAQLLAAGVGNVLVGTTGRYAISTRVKWDKLLERMFRGFPAVDV

SEQ ID NO: 5559 - protein, 121 aa, Corynebacterium glutamicum
MTSPTTLKPWSIRGPIDGEYTMLEAYPFQYVANTRPAIMLYALDENGVPEQYADLTINLADVELKQLNHVIINPDLHADVTELCISAGLLRPGVLGQHQVGSTTAKVYRLTERADGWLQLF

SEQ ID NO: 5560 - protein, 91 aa, Corynebacterium glutamicum
MPQYTITITDEQKAVLHSLTNPHIATAEHGAITAIEIHDDHDVVVYHVQPDGTLTYERLVEGFHYGWTRFDSEGFEIDSDNNRVVDGLRDE

SEQ ID NO: 5561 - protein, 88 aa, Corynebacterium glutamicum
MSTTKTPRSTITAPIDQLSPIMRWVFQATNFLGSLIKPLLIVTALVLVVAALTPERFHETLVLNILAFSAGYAVLRLVRSLRRLLQRH

SEQ ID NO: 5562 - protein, 78 aa, Corynebacterium glutamicum
MAQYRVSFIALAESTIEVEADSPEEALDLANAEFDYPVTLAGDPYELHDWEARAEIEWLDTSSTPQQRLGEHVVKIED

SEQ ID NO: 5563 - protein, 114 aa, Corynebacterium glutamicum
MARYQLDPAATPWRTCRQDRRLNSIIKHTLKIRTLIMATHRVHFVATASAYIDVEADSPEDAIEKAYDLAGDLPGLIADNEFDLGEWEVQADVQWPDNSVPREQRLEEGVDLLD

SEQ ID NO: 5564 - protein, 91 aa, Corynebacterium glutamicum
MFVAFMIPIVMALGAMAVITLFGQNPSQRRKRAQQQSKDRYEGAIRSGQFIDHCNCPRCRRNCRRRHKKLKGFSGYPDEILGKYPVKYLSS

SEQ ID NO: 5565 - protein, 101 aa, Corynebacterium glutamicum
MLLTGKVFNRILPQNFIGVSAEAFELLVPATAVASATWAVAVVNKLTGANSALVAIFGLLLGALAALGWVLPKEGNNSHGTKCHNNRDHKCDEHGDCFLCG

SEQ ID NO: 5566 - protein, 383 aa, Corynebacterium glutamicum
MSRSRNWGEIEKLRSGRYRARFMHEGRRYSAPYTFGTKGEAQEFLASERTAIINGTWMDFEMRERFEQAQREAEERMMETFFSYASRWIETRTNAQGKKLSQGVKDDYFRYIKSDRLSYWADYALCEITVADVREWYSDTIQDGKLTSMARSYSMMKSVMETAVEDGIIPMNPCKVRGGGNTKTGKKVDVPTDAELEAIIGALPSKYFCLAIVAAAGALRFGEIVALRTTDVDVYFDRSGFVDCVRIRISRSIRHTRYHGRVEGPPKTEAGVRSLYIYGKDAAEIAKHVDTIDVGLRLWSSMRDPDEPMPYHTFKHNWDRARESVHSKATVHSMRHYSGTKYAQVGATLKEVMARLGHSTPSAALRYQHSGERDEELAKRMAR

SEQ ID NO: 5567 - protein, 130 aa, Corynebacterium glutamicum
MLFLARLVGFAFADHMRTSLVQEALMMAKSQRGSLQGAVFHSDHGSVYTSQAFQDTCKKLGVRQSMGAVGTSADNSLAESFNAALKREVLQDSKTFANQLVCRREVFRWCDLVQHGAQTFLVWLCGACGV

SEQ ID NO: 5568 - protein, 139 aa, Corynebacterium glutamicum
MKINRSSYYKWKKTALTRKKLLLSDAVLGAKIKSIFTKERGCYGAKRITAELNDGPGTTTPVNHKRVARVMSSMKLVGFTKKRKVITTIPAAVKPVFPDLVKRQFNALAANEVYVGDITYLPIADGSNMYLTTVIDCYS

SEQ ID NO: 5569 - protein, 69 aa, Corynebacterium glutamicum
MPGKYLAALRKMSRSSRSSAFSFFSCLICSASDIAVASLVLVEACAPYLLIEVFQGYSVDAEIVGDLLE

SEQ ID NO: 5570 - protein, 38 aa, Corynebacterium glutamicum
MSEAEQIRQLKKENALLREERDILRKAAKYFPGKRQDL

SEQ ID NO: 5571 - protein, 45 aa, Corynebacterium glutamicum
MPTKTYSEEFKRDAVALYENSDGASLQQIANDLGINRVTLKNFDQ

SEQ ID NO: 5572 - protein, 276 aa, Corynebacterium glutamicum
MPALPSSIIDPLWRQFSALIPPVIITHPLGCHRARIADRIIVDKLIAVLVLGVSYIKISDSTCSATTIRTRRDEWITAGIFKNLEQICLESYDRFIGLDLENLNVDGCIVKAPCGGEVAGRFPVDREKGTKRSLMVDGHGIPIGCVVAGANRHDLPLLAATLDTLGRFGGSLPDQITVHLDAGYDSKKTRRLLSEFGYSWVISIKGEPLQAGTRWVVERTNSWHNRGFKKLSICTERCTRVVEAFIALANAVIILRRLIKQAWTSYRWDTRPGHRP

SEQ ID NO: 5573 - protein, 118 aa, Corynebacterium glutamicum
MAERIALLTLLKPAIKGAKISPSRRKASSVLFIPVHAFLLVHVGKCFPHTCFLKALKLQALSPKKELFSGAFRVLTRVVHTAGAFTTIPCPKTLKCVTKIFGVPALNAHVHAVRRDRQ

SEQ ID NO: 5574 - protein, 297 aa, Corynebacterium glutamicum
MNKTDEAFLLEGDIFAPLIAGLSSVNSAIRSATVQHAFRSMDRAAATGTTYGASIVQSLCDIVVTHMFVESDFPRKYGWSEITVGRQIFEQLGRRLGRASDESPERFEAQAVPSTHVFHAPLDKTPSFEVEVSLRLYALKTDSVNVSDCCFSGANFGECSWQYARLTNCDLSYCSFIGAQLGDTVISGDLSHSRFREAVINFADISADITNAFFGNADLQGSRCVFKNASDAIFRGCNLKGANLEGSDDAINLSEAVVDHETVFPDGSLLERKRYSDYETISTKWGEVQFVADRYCS

SEQ ID NO: 5575 - protein, 144 aa, Corynebacterium glutamicum
MGFSALEMWSTELGITVSVAPEPQNSDYESGLAQVEGHEWHVRTGRNTPSKPGAFVAFWQRGVGGQTQPFSDDGMNAGLLVFVRNDVRRGVFRFSAGHLAELGITAADGQPGKRGFRVYPSWCEGLNSQARAMQRAQSSAFEEY

SEQ ID NO: 5576 - protein, 248 aa, Corynebacterium glutamicum; identical to SEQ ID NO: 5530

SEQ ID NO: 5577 - protein, 528 aa, Corynebacterium glutamicum
MRSDVIELPEGVSKEKADQLEVAEARLNEGARLMATTGCEVMWPTGFSVCGRILDTYRQVGGQLSWLGPPKSNELTNPDGVGKRSEFFGGAIYWHPDTGAYAVTLDGLRQWGTLNWESGPLGYPTSGPMDTNYPLTQRQTFQGGDNYYNPLTGGAVWGDIKQRYEELGGSNHAIGIPITNELPSGTEYFYNNFSNGTISWRNDRQTRFMYLATQRVWDALGRETGRLGFPEADETPEVSGLFHVVNFAERGVIAWNGILGARELYGDVYSLWLQYQNTDTPLGWPIPSLTSLNESLEQEFTRGVVLGSGDALTWIPDDEERSLEDFLPIGSSGSSSSSQEMTLFSQRAQYVDCKNLPDLDEQRKTENNIEKNGGPIKKEYSSRGFPTEFRFVVRKGHYDRYRNEGWGYLKNYCKHNFANHAMAEAVVDKAVIDYGSSPGTSYYKFEKTVYFLDCRTYTFNKNSGCKEMHAPQWVTIIYNPHTFTGANSNRPKGVISAWCNSTPPGGIEHEPEISQCPDHVNLYNKLRI

SEQ ID NO: 5578 - protein, 229 aa, Corynebacterium glutamicum
MRSERYRARFMHEGRRYSAPYTFGTKGEANEFLASERTAIINGTWMDFEMRERFERAQLEAEERMMETFFSYASRWIETRTNAQGKKLSQGVKDDYFRYIKSDRLSYWADYALCAITVADVREWYSDTIQDGKLTSMARSYSMMKSVMETAVEDGIIPTNPCKVRGGGNTKTGKRLIPQPMPSLKRTLVHCRVSTFVWLLLLLPAHFDSVKSLRYEPPMSMFILIAADL

SEQ ID NO: 5579 - protein, 102 aa, Corynebacterium glutamicum
MLHRHLISETTSNTAAAAVTVPIVVPLAIAAGIDPVIPAMAAAFGASFGFMLPISTPQNAIVYGSGCVSIARMIRTGISFDIIGGALIVFFLPTVATMVGIG

SEQ ID NO: 5580 - protein, 144 aa, Corynebacterium glutamicum
MFEQALGLTTLAQTAGAGAAGGLGFMAMALLSAGMRSGVDMILNETGGEKMLAQADLVITGEGRIDAQTLSGKAPTGIAKRARAKGIPVLAVCGQSLLGPAISNELFEDIYSFTDFESDINECIRNPLPILEGIGFNIAKHHLS

SEQ ID NO: 5581 - protein, 115 aa, Corynebacterium glutamicum
MSSFTRRLNITAVTVAIAATSLLAATTPASAACLDANGQQIGPLRVHASSENTSRVNDCEKVYLGTFWEGTNGEPGNFGIFNFKYANNKYFVVGINDITGLGLGSSDQNPLGTFG

SEQ ID NO: 5582 - protein, 112 aa, Corynebacterium glutamicum
MSSFTRRLPVTAVTAVLASSTLLAAATPASVKCVHPHSEHVGPLHVYGSSENSDRFDVCGKIDFGTHWEGTGIHTGQFGLFNVKYADNKFFVVTIDDAGLGSSDQNPTGTFG

SEQ ID NO: 5583 - protein, 232 aa, Corynebacterium glutamicum
MVDILELIGPLPSVSTPELRAIVVTAINGSTTINGTSGQLGNSTDTELLLALRRWSDVVLVGSSTVKAENYGGVEVSPEIQKQRQELGQEAIPPIAVMSGSLNFDVDTRFFLEAEVPPIIITDNSDQAKQQRLVDAGAQVIEVETLTAEVGVEKLRSLGYARIDCEGGATLYGQMLAADLVDVWHHTIDPTLSGSVERPTVKGGDDAPRRFALEHVFVDDDSTLFLRYKRAK

SEQ ID NO: 5584 - protein, 418 aa, Corynebacterium glutamicum
MSFSPVAPSISAPTPRRSRWDSIGNAVAWPLAMLLMAHRFFVLAINGAVTDDFTTVYSALRRFVEGIPVYNEVYHFVDPHYLYNPGATLLLAPLGYITHFTLARWMFIAVNLLAIVLAFGLLTRLSGWALRSMVWPIAIALAMLTETVQNTLIFSNINGILLLMLAIFLWCVVHKKSWLGGLVIGLAILIKPMFLPLLFLPLVKKQWGSLILGILTPVIFNAVAWFLVPGASEYVTRTMPYLGETRDFANSSLPGLAIYFGMPTWMEITWFLIFGAMVGLAVLALLRFRNTEPYFWAATTTGVLLTGVFFLSSLGQMYYSMMIFPMIFTLLGSRSVFHNWVAWVAAYFFLSPDTFTSQRLPDVARWMEFFSATVGWGLLIVVTFVSALIWFIGDIRAKGTPSSPITTDPTHDHLERTA

SEQ ID NO: 5585 - protein, 136 aa, Corynebacterium glutamicum
MTDFKLISDTEWRERLTPQEFHVLREAGTEPPHVGEYTNTTTEGVYSCRACGEELFRSTEKFESHCGWPSFFSPLAGDKIIEKEDLSLGMRRVEILCANCGSHMGHVFEGEGYDTPTDLRYCINSISLKLEEKPVS

SEQ ID NO: 5586 - protein, 142 aa, Corynebacterium glutamicum
MVRPKSCPGAHEKCPLRIASKRLNALNPYKNPSQKLGLLNSARMRKSLSHKAKARFVLGSLGNWLFFQLQADGVNAVTKIGGGVVAFAFEDVTHVRAAVSAQNLNATHTEGKIFLLNDFVASKWGEEGRPTAVGFKLLGGAE

SEQ ID NO: 5587 - protein, 232 aa, Corynebacterium glutamicum
MSELDIKQLNKLQRYSQWAVFRAIPGALDDDRTEVTDQAAKFFADLEAEGKVTVRGIYNASGLRADADYMIWWHAEEFEDIQKAFADFRRTTILGQVSEVFWIGNALHRPSEFNKAHLPSFIMGEEAKDWITVYPFVRSYDWYIMEPLKRSRILREHGQAAVEFPDVRANTVPAFALGDYEWVLAFEADELHRIVDLMHKMRYTEARLHVREELPFISGQRVDIADLIKVLP

SEQ ID NO: 5588 - protein, 208 aa, Corynebacterium glutamicum
MQIVIDSEATSQHKTSATPAESTPAEFSEAVESMHRARLRPELTLGTIRPPQRLAPFSHAIGLEVGNQEESDDVSTNSEGDSFGRLILLHDPGAEETWEGAMRLVAYIQADMDHAVASDPLLPEVAWQWLNEGLEQAGAGFTNLGGTVTSTTSVRFGEIGGPPSAYQVEMRASWTATGTDLTAHVEAFAAVLASVAGLPPEGVTELRR

SEQ ID NO: 5589 - protein, 421 aa, Corynebacterium glutamicum
MLDFPQRASPNYEGRLDTMVSDLLQPRDGIPPLLSTPGEFTAAADLLASGTGPFAIDTERASGFRYDDRAFLIQIRRRGSGTLLFDPEQFRPELTQALKPVLNGQEWIIHAASTDLPSLAWLDLHPGLLFDTELAGRLAGFDHVNLAAMVEQIFDLHLLKGHGSEDWSKRPLPESWLNYAALDVEMLLELADVMAEILDQQGKLPWAEQEFVHIVDQFATMTEPSETSWQDLKGLSTLKRPDQLVVAREMWLERDSFAASRDLAPGKVLSNKVIVEVARVLPRTPAELAQVKGFPGRSQGATKRWFRIITRALKSPRRNWPKPQQRKDGIPDRRAWASYYPEEHEVLQEIRALIDDLAADINVPGENILQPSTLRVAVWMAKHTGEIHNAETLNAVLRDYGARQWQIDQTFPILSANLLKL

SEQ ID NO: 5590 - protein, 636 aa, Corynebacterium glutamicum
MGILNSISTPADLKALNDEDLDALAKEIRTFLVDKVAATGGHLGPNLGVVELTIGLHRVFDSPQDPIIFDTSHQSYVHKILTGRAKDFDSLRQKDGLSGYTCRAESEHDWTESSHASAALSYADGLSKAKQLDGDTTHSVVAVVGDGALTGGMCWEALNNIAAGKDRKVVVVVNDNGRSYSPTIGGFAENLAGLRMQPFYDRFMEKGKTSLKSMGWVGERTFEALHAFKEGVKSTVIPTEMFPELGMKYVGPVDGHNQKAVDNALKYAHDYDGPIIVHMVTEKGRGYAPAEQDLDELMHSTGVIDPLTGAPKSASKPGWTSVFSDELVKIGAQNENVVAITAAMAGPTGLSKFEANFPNRFFDVGIAEQHAVTSAAGLALGGKHPVVAIYSTFLNRAFDQLLMDVGMLNQPVTLVLDRSGVTGSDGASHNGVWDMALTSIVPGVQVAAPRDEDSLRELLNEAISIDDGPTVVRFPKGDLPTPIVAIDTLEDGVDVLAYEDATDVESTDDAPSVLIIAVGERATVALDVASRIKQHGVNVTVVDPRWIVPIPQSLVALSDDHDLVITIEDGVIHGGVGSLLSDALNASEVDTPRRQIAVPQKYLDHASRNEVLADYGLDADGIETTVVGWLDSLFGE

SEQ ID NO: 5591 - protein, 412 aa, Corynebacterium glutamicum
MTDTVELAKGDIISVEVLRPAHGGEGIGHHDGRVIFVKGGIPGDVVDVEIAQLKKKWARGEVVKVTTASADRVDSRCPAAAAGAGCCDYAELNPTVELEIKSRVLRDQLERIGGIDELPEFELQDLEPTAGWRTRVRLGVDASGRAGFRKLKSNELVTEVACSQVVPELLEGLVGEGARRFTPGVEIIAAIDDAGQRHVVESRKAPRGRRTETVLKVLEGTGEVEQKVGDYTWKFPVSSFWQAHTKAPAAYSEFIAEALTGLELVDVDKRGPVAWDLYGGVGLFAPIITSKLQAAVHSVELSPGSAEAGEEALAGLPVTFHTGRVEGMASQLPSPNVVVLDPPRTGAGSDVLKSIAEAKPQLVIHIGCDPATFARDVADWKLNGYEMDQLAVFNAFPGTHHFETIGVFVRVS

SEQ ID NO: 5592 - protein, 94 aa, Corynebacterium glutamicum
MSVVLVSLEKVSVPLLGAGQRKEFNPTLRWGYFPDRGSDLGFRYLLQVAVLHFAALLAEPWPAEPAPPAALEVPLEVGCQPGLGRRHGSQRYEQ

SEQ ID NO: 5593 - protein, 287 aa, Corynebacterium glutamicum
MALWPFGKKKEVVDETPAAPEVSEVPAAPEAPVEADSAEASVPEALRSLGEQPVLDEDPSAGEPDPVHDAINGDMGPFDAGSVNIQDFDFSDFSKGVLDLGSIQVPLPQNSEVQVEMGEQGPRMLHVVTQFGRITPVAFAAPTSAGQWREATKEIAEGMRRDGLTVHVEKGPWGREVVGEANDRKIRIAGVDGPRWMLRMTMISPSDRADDMRDLGREVIARTFVNRGDAPILAGSPLPVALPKQLAEQVQQAMAQRAAQQNATQQPAAGNGTPDQNPDQGNTPNAE

SEQ ID NO: 5594 - protein, 149 aa, Corynebacterium glutamicum
MTDLAAIKIVRLDKELPLPKRAHRGDAGVDLHATTDAVIAPGHREIVGTGIAIALPLGTVGLVHPRSGLAAREGLSIVNAPGTIDADYRGEIKVCLINLDPEKPIMITRGDRIAQLVIQKVELVDFEEVEELDDTVRGDQGYGSTGKTA

SEQ ID NO: 5595 - protein, 183 aa, Corynebacterium glutamicum
MTDSRQSDSASSAPSSNSADGVTTIYRERQWVPWYWWLAMAFVVALLTAQFGLNRNEYWIYIPAVLLSIVGVWVLVSMSNTVITVEQDADGTRWLIAGQANLPSDVVSRSLAVPATAKRNAMGRQLDPAAFVVSHGWVPEMVMLVLDDPEDSTPYWLIGCKDPEALLRAFVPEQADAALADFR

SEQ ID NO: 5596 - protein, 69 aa, Corynebacterium glutamicum
MNINNHTYQVSWSEDDQEFLATVAEFPSLSWLFSDQQEAEAGLRNLVAEVLDDMKQTGEQIPTSVGRNL

SEQ ID NO: 5597 - protein, 97 aa, Corynebacterium glutamicum
MATDYDAPRRRVEDELETDSLEGLKAVENANSDMDDDGEIVESFEIPNVDLSGEELNVDVVPRRADEFTCASCFLVQRNNRKSHVEPDGSIICLDCA

SEQ ID NO: 5598 - protein, 272 aa, Corynebacterium glutamicum
MRAIAAETATLTAVRIRDKRAELTNLWDYTNTKSSTVDPVTIVDTLAEDFIANRLQELRPKDGLIGEEGTGTASISGVTWIVDPIDGTVNFLYDLPQYAVSIAAAIDGEVVAGAVINVVTGVLYTAARHEGATKYLPERDEIVPLKASAATVVSESLVATGFSYSALRRSLQADLLTKILPTVRDIRRMGSAALDLCHLADGQVDIYYEHGLNCWDFAAGSLIAAEAGAFVRAPGLSIPGSSGEICFGAAPGVFDDANAHFDVVGAFKALDR

SEQ ID NO: 5599 - protein, 276 aa, Corynebacterium glutamicum
MFHKTIIVVFLENCLPKAEVICTLGRMTETGFGIDIGGSGIKGARVNLKTGEFIDERIKIATPKPATPEAVAEVVAEIISQAEWEGPVGITLPSVVRGQIALSAANIDKSWIGTDVHELFDRHLNGREITVLNDADAAGIAEATFGNPAAREGAVILLTLGTGIGSAFLVDGQLFPNTELGHMIVDGEEAEHLAAASVKENEDLSWKKWAKHLNKVLSEYEKLFSPSVFIIGGGISRKHEKWLPLMELDTDIVPAELRNRAGIVGAAMAVNQHLTP

SEQ ID NO: 5600 - protein, 498 aa, Corynebacterium glutamicum
MESSMVENNVAKKTVAKKTARKTARKAAPRVATPLGVASESPISATPARSIDGTSTPVEAADTIETTAPAAKAPAAKAPAKKVAKKTARKAPAKKTVAKKATTAKAAPATAKDENAPVDDDEENLAQDEQDFDGDDFVDGIEDEEDEDGVEALGEESEDDEEDGSSVWDEDESATLRQARKDAELTASADSVRAYLKQIGKVALLNAEQEVSLAKRIEAGLYATHRMEEMEEAFAAGDKDAKLTPAVKRDLRAIARDGRKAKNHLLEANLRLVVSLAKRYTGRGMAFLDLIQEGNLGLIRAVEKFDYSKGYKFSTYATWWIRQAITRAMADQARTIRIPVHMVEVINKLGRIQRELLQELGREPTPQELSKEMDISEEKVLEIQQYAREPISLDQTIGDEGDSQLGDFIEDSEAVVAVDAVSFTLLQDQLQDVLETLSEREAGVVKLRFGLTDGMPRTLDEIGQVYGVTRERIRQIESKTMSKLRHPSRSQVLRDYLD

SEQ ID NO: 5601 - protein, 445 aa, Corynebacterium glutamicum
MSDSAPTTHTKAVRTAQKTRILSPDIARGIALLGIALANVSTAWIAAPAGSTAASLGGIVHDSIFEKIYAVFSAMFIHVRGLPMFSTLLGYGVGMIVYSLWRRQYPDTAARGVLLRRYGFLALFGVIHMVFLFWGDIMFFYGVAGMIFAMLMTLKDKTLWWIAGSMSAIYVIVGITLGVVLPLYFGVSTDTMASLDLTFDSYLEYLGMGLLSVPIQIGSVPVEILMLMPVMIVGYIAARHRVLSRVDEFRKPLWIATWIFIAIAVLVGVPWGLAEIGVFSAQTATVFSGLNQAVGSLTGPGIVAAVALLVQPLQRKINKGNGHLPLPIKMIAALGARSMSGYVGQSILFLILTQTYTLGLGQGGGILAEAGVATCVWLLTLIGAYGLELAGKRGPFESMHRYIAYGKKGLQDPYVPKQLPTPAAYPQIPGTTPLDKASDKYTQGN

SEQ ID NO: 5602 - protein, 179 aa, Corynebacterium glutamicum
MTTPNYPYGEPNNNGGNSNDPFNANQGEPYGAPYGESFGPSSGAQQSGYQDPYGSGYTGGFENSPLNAPKNTAAAWALGLGIASIVTLVTVFGAFLSPFLALAGVIVAIIALVKAKNFVPANRRKGFAITGLILSILTLILLAIGVILILVVFSSSGLSECATLTDPAAQEQCIQELFA

SEQ ID NO: 5603 - protein, 570 aa, Corynebacterium glutamicum
MSSNLRAWQRAALDNFLANKPRDFLAVATPGAGKTTFALRVATELKASRTVDRIIVVVPTEHLKVQWSQAAARVGLALDPEFKNSGSINPAYDGICVTYAQVSMHPFKHYQLTMARRSLVILDEIHHGGDAKSWGDGISQAYRDAEHRLALTGTPFRSDDSQIPFVRYQEDDEGHLVSKSDHTYGYSEALADGVVRPVVFLAYSGEARWRDSAGEEYAARLGEPLNAEQTAKAWRTALDPKGDWIPAVLSAAHTRLMQLRQNIPDAGGLVIASDTKTARAYAKILGTLSSTPVAVILSDEAGASERIDEFSASTDEWMVAVRMVSEGVDVPRLAVGVYATSASTPLFFAQAIGRFVRSRMPGETASVFLPSVPVLLELAEKLEVSRDHVLGKPHRPKEGWDDELLQEANRKESEPDDMPKYESLGAEAELDSLIYDGSTYGTGTFSGSAEEADYLGLPGLLDAEQMRELLRKRQEEQLDARDAAEKRRKELEKQQQREAEIHEKPVEEVASDEIPRLRKELNTIVSITSGRTGRPHGAIHTEARKHCGGPPTALCSAEQLRARIDYLRKW

SEQ ID NO: 5604 - protein, 212 aa, Corynebacterium glutamicum
MEELRGVVACRVIFPDIGTFNGLCCCSHLTHHAPDSSVVTKRTTLFGMNQRKDRPDGTSDESEHSPKKRLRKLFHRNEVLLITDKKRTPMQDMRHRRRIYNVIQALRIPLLILAGVSWVMWHAWVLSIIIFIISIPLPWVAVVIANGHGSPRDPREKNVYKPGLVREMNERAQLEAQQAQQLENRSTEVDIRRTFDGIIIDAQEEKDTNDND

SEQ ID NO: 5605 - protein, 79 aa, Corynebacterium glutamicum
MRTTTKTIERPDVREDNATSDDTPKFFHYVKKDQIVESAVSGRMVVALCGETFPVTKQAKPGSPVCPDCERIFKGMRKK

SEQ ID NO: 5606 - protein, 511 aa, Corynebacterium glutamicum
MTMTRTPLTQAAATLKARFREIGYTTSGINNVLGPDFVAAMHAGQPAAVRFHLDSLPESDLNLALRAFVLRDQVRVEKLAALLGEALKTLVDASLVEISGEYAQFLIDIRPHLIAGRQQWVFSDADASMTQHVPGPDHVLGVGAASLSLLQATPTSPTGSVLDLGTGSGIQVLGQAGAAQEIIATDVHPRALDFAEATLVDSGIPTQLVEGSWFEPVRGRTFDRIIANPPFVVGPPEIGHVYRDSGMDLDGATALVVKEACAHLNPGGTAHLLGAWVHSADQSWQQRVAEWLPDNGYVAWVIERDAVSPAQYVGTWLSDESLDLRSPEAAARTTAWLNHFEKAKVQGVGFGFIAIQRLEEDEADEKSDILAESMTQYFEDPLGPEIEEYFTRTAWLREQTRDSILSSRFKVRPGVAREQISLADAEEGMGFSPVTLRLTRTDGPRWSHDVDEHVASIVAGLNPHGLPFEEILEMYAMAQGIEGESLHNGAIAALVDLIRHGLVLPADLLDS

SEQ ID NO: 5607 - protein, 144 aa, Corynebacterium glutamicum
MKAVLTRVSSASVSVDDEIVGAIDCPDTGGILALVGVGAADSDDAWETMVRKIAELRILDGEQSVSDVNAPVLLVSQFTLHGRTAKGRRPSWSDAAPGEVAEPVIEKIAQGLRERGITVEQGRFGAMMKVTSVNEGPFTVLVEC

SEQ ID NO: 5608 - protein, 228 aa, Corynebacterium glutamicum
MKDLVDTTEMYLRTIYELEEEGIVPLRARIAERLEQSGPTVSQTVARMERDGLVHVSPDRSLEMTPEGRSLAIAVMRKHRLAERLLTDIIGLDIHKVHDEACRWEHVMSDEVERRLVEVLDDVHRSPFGNPIPGLGEIGLDQADEPDSGVRAIDLPLGENLKARIVQLNEILQVDLEQFQALTDAGVEIGTEVDIINEQGRVVITHNGSSVELIDDLAHAVRVEKVEG

SEQ ID NO: 5609 - protein, 78 aa, Corynebacterium glutamicum
MSKPMMSVRRRSARRCLRITAMARERPSGVISRLRSGLTCTRPSRSIRATVWLTVGPDCSRRSAIRARRGTMPSSSSS

SEQ ID NO: 5610 - protein, 329 aa, Corynebacterium glutamicum
MKLLVTGGAGYVGSVAAAVLLEHGHDVTIIDNFSTGNREAVPADARLIEGDVNDVVEEVLSEGGFEGVVHFAARSLVGESVEKPNEYWHDNVVTALTLLDAMRAHGVNNLVFSSTAATYGEPDVVPITEDMPTQPTNAYGATKLSIDYAITSYAAAFGLAATSLRYFNVAGAYGNIGENREVETHLIPLVLQVATGHREKTFMFGDDWPTPDGTAVRDYIHILDLAKAHVLALESNEAGKHRIFNLGSGDGYSVKQVVEMCREVTGHPIPAEVAPRRAGDPATLIASSEKAKQELGWTPEHTDLRTIVEDAWAFTSALGDRSHAAKKKA

SEQ ID NO: 5611 - protein, 441 aa, Corynebacterium glutamicum
MNFAKSKLQTWFSSTNFMKRELDLRAGLVEIEKVPVDNFSYPQFSRSPQEAGETSPQSPDILCSMTAKAHRNEPTTVLQTPGQLLANIPGILGFYPSESIVLACMMQEDDATTLTLGPVIRLDVGDTRLLPDVGQAVDSFNPTRIFAFLITKELPPNALDDTLEQLLATAEQGIVNITGCWYTKEVISSEPYMLCFGPEPEALAADDHGISEWEFGRIAPISSAAATKRMLQEGQLPELNRHEAYALFEQNNPHVSASKRKKLEKDARTLAEDIQHQINADDSGYYYLTSLDVLTRALEFVKANYIDSSSGAENFDGLLGEVDILQTVATYMAGSFLRDAVLHLCVDFPREATLLLRAAACTFTGEFRSNALCLYALSVIAMGLSMKASPALEAAIEATPRHNLSNLLREGLFNGETTKLIDACLRGNQQLRDFHVPDPKA

SEQ ID NO: 5612 - protein, 319 aa, Corynebacterium glutamicum
MSDNNDRMYELEYPSPEVSGQTAGGPTLIVALQGYADAGHAVESSSSHLMDALDHRLIASFNNDELIDYRSRRPVVVIEHNEVTSMDELNLGLHVVRDNDNKPFLMLSGPEPDLRWGDFSNAVVDLVEKFGVENTICLYAAPMTVPHTRPTVVTAHGNSTDRLKDQVSLDTRMTVPGSASLMLEKLLKDKGKNVSGYTVHVPHYVSASPYPAATLKLLQSIADSADLNLPLLALERDAEKVHRQLMEQTEESSEIQRVVGALEQQYDSELERYRNRHPQAVMPGESELPSGDEIGAEFEKFLADLDDQGGSDHKETPEA

SEQ ID NO: 5613 - protein, 850 aa, Corynebacterium glutamicum
MWLIVNLSEMLPDLSDVPESLMDESIFDSFLSWTRERGISLYPAQEEAALGILAGDNVILATPTGSGKSMVAIAAHFIAMARGQRSFYTAPIKALVSEKFFALCEIFGAENVGMMTGDATVNGKAPIICATAEIVANIALRDGSGAAIDQVVMDEFHYYSEPDRGWAWQVPLLELSRAQFLLMSATLGDTEWLEKDLQQRTGRTANFVGGTERPVPLEFSYVYTPVHETIEELLKDSKAPIYVVHFTQRDAIERAQALTSLTVVNKEEKERIAEEIGDFRFSTTFGKTLSKLLRRGIGVHHAGMLPKYRRLVEKLSQTGLLKVICGTDTLGVGINVPIRTVLMTGLVKFDGSRERVLKSREFHQIAGRAGRAGYDTIGTVVIQAPEHEIENHRLREKAGQDPKKLKKLRLKATRPGEVTWTKKTYERLTTAEPEQLTSYFKVSNSMLLNVIARPGDGYQHMKHLLRTNHDTRTKQNKDILTAVELFKGLINAGIVEKVPDGPDATGRIYALTEELQRDFALNQPLAPFALAALTLLDKESETYTLDVISVFEAILEDPRQILLAQQKAQRGEEIEALKAEGVDYNERMAIIEDVTWPKPLEEELESAFETFREGHPWAKEFELKPKSVVRDMIEHGMTFSDLVATYGVARSEGVALRYLTDAWRTLQHSLPTEARTEELDDVVVWLGELIKQVDSSLVDEWAQMADPEAPISKEALERELAFGVEDPTALTANRRAFTIMVRNAMFRLVELFAYEKEDQLSQMTEYLDEAPDFGAAMDAYFDEYADLDTGPAARGPEFFKVEHTGRMWEVRQVVKDPEGDNSFAFVATIDLDASDDAGEVRFGSLSIDHN

SEQ ID NO: 5614 - protein, 327 aa, Corynebacterium glutamicum
MSNKEYRPTLAQLRTFVTIAECKHFGTAATKLSISQPSLSQALVALETGLGVQLIERSTRKVIVTPAGEKLLPFAKSTLDAAESFLSHAKGANGSLTGPLTVGIIPTAAPYILPSMLSIVDEEYPDLEPHIVEDQTKHLLALLRDGAIDVAMMALPSEAPGMKEIPLYDEDFIVVTASDHPFAGRQDLELSALEDLDLLLLDDGHCLHDQIVDLCRRGDINPISSTTAVTRASSLTTVMQLVVAGLGSTLVPISAIPWECTRPGLATANFNSDVTANRRIGLVYRSSSSRAEEFEQFALILQRAFQEAVALAASTGITLKQNVAVAQ

SEQ ID NO: 5615 - protein, 363 aa, Corynebacterium glutamicum
MSRDDQTNNNGEGDDTSREQSWDQSWQNLNKDSQYGPTSHPEDAPGGFQGNGQGNSRGNAQGNGQGNGQGFGPGNASGYGGYGQPYPQTPYQNSYQGYGATSPQNDVALEASNGKVDIMRAIRFGFKATFANPAVWILGTVGLGLAFMIVSGLLGYLSFLIDPNAGTTTSGFSVSETLLNVAIGIITFAITICVMRGALLSVDGHKVRFGDFFKPINVGQTVILMVGLGIFGIILGTFTTFLTQNLVSFNDAAGTVEVNNSGLGMFFIVYLVLFFINPLYSYWVYYTADGHHTAGSAVQTGFKDSLRNYPMLLLFSLVGGFATLIIGIFTIGFGLIIVLPVMMLSTVHIYRQISGGNIPVERR

SEQ ID NO: 5616 - protein, 1302 aa, Corynebacterium glutamicum
MTTSETAPSKASLYELLEGVSLSDERTFRRRLSKARAPKALGAIKADIDKARLLIDEKSQLIPSITYPENLPVSSRRDDIAEAIRDNQVVIIAGETGSGKTTQIPKICLDLGRGRRGLIGHTQPRRLAARTVAERIADELGQDIGESVGYAIRFDDRVSSHTSVKLMTDGILLAEMQRDRFLNAYDTIIIDEAHERSLNIDFILGYLRQLLPKRPDLKVIITSATIDPERFAEHFADASGKPAPIIEVSGRTFPVEIRYRPLEVLDGDKIIDTDPLDGLCSALEELMAEGDGDILCFFAGERDIRDAMEAIEARRWKGVEVTPLFGRLSNQEQHRVFSPHSGRRIVLSTNIAETSLTVPGIHYVVDTGTARISRYSVRTKVQRLPIENISQASANQRSGRCGRVADGIAIRLYSEDDFNSRPEFTDPEILRTNLASVILRMASLRLGDINDFPFVQAPEQRSIRDGILLLHELGALTDDTQADGSPQLTQIGKDLANIPVDPRMARMLVEANTLGCLHSVMVIVSALTIQDVRERPLEFQAQADQAHARFKDTTSDFLGFLKLWEYIADQRNQSSGNSFRKQMKKEFLHYMRIREWWDLVRQLEQIGQQLGWAKKEQVAGTASPDIIHQSLLTGLLSQIGSRDGESKEFTGARGTKFLVFPGSALTKKPPQFIMAGQLVETSRLWARDVAKIEPEWVEKAAGPLLKHQYSEPYWSSKRGAAMVHRKSTLYGVTIVADKVVPYHTVDPVAARDMFIRHALIEGDWSTHHRFYHDNVAKLEAIGELEAKARRRDIVVDEDTLFDFYDAKLPSNATTTRNFDSWWKKTSRVTPDLLDFDPDSLINEDADGVNEEAFPDKWIKGSLIFDLSYHFEPGHRDDGVTVLIPIPVLGGLDTEGFDWLVPGLRLDLVTELIRTMPKALRRTVVPAPDFAERVLPLLRPYMTPLTTQLADALHTLGGQGINASDFDPAKLPDHLRISYAAVDRRGKIIDRDRDLEALKKRRANQIRASVSSVAKASEQDETTQWTTDTLGTIDEEIETTVDGQSVTAYPALVVTPTGVSVKVMPTKAAADASMITATLTLLMREIEVSTKQMVKGLPLQQRVAVDNYPHGGAEGLVSDARIAAIRDLMFEHGGAVRSPEEFDVLLAKVKPETPGVVRRTVVELAPALVHYASVVSELESWSGPAIDDMTAQLDFLLPKQAISIHGISRLRHLPRYLQALTIRLEEMNQNPDRDADRQDEVNFVEEQLEKQLSKLPAARANTKEAKDIAWQIQELRISLFAQRLGTPRPVSAQRIQKAIAKLR

SEQ ID NO: 5617 - protein, 150 aa, Corynebacterium glutamicum
MYCPFCQHDHSKVIDSRVIDAGSAIRRRRECSKCEGRFTTIEKAVLLVVKRNGVTEPFSREKVVTGVRRACQGRDVSDDALKRLAQQVEETVRSNGSSQVRANDIGLAILDPLRELDEVAYLRFASVYKSFDSADDFEKEIRLMRRRGRD

SEQ ID NO: 5618 - protein, 140 aa, Corynebacterium glutamicum
MTVYAGKELDSRKLRQGVVVPSAAVWMGEGAGLKSANKRHVRTIDCSNGDRFHQPSSLRILPHGERNYRTSQQQVREQDPENTTGGNSDARSIKESLKQWAGGGLFGLVIFAGILLSQSGEEEVSQNYYETQMVGVSLGR

SEQ ID NO: 5619 - protein, 232 aa, Corynebacterium glutamicum
MPNGKPDPASLSDRQRRILEVIRDAVVLRGYPPSIREIGDAAGLQSTSSVAYQLKELEKKGFLRRDPNKPRAVDVRHLPETESRSSKAATQAKSKAPQAGVHDPELAGQTSFVPVVGKIAAGSPITAEQNIEEYYPLPAEIVGDGDLFMLQVVGESMRDAGILTGDWVVVRSQPVAEQGEFVAAMIDGEATVKEFHKDSSGIWLLPHNDTFAPIPAENAEIMGKVVSVMRKL

SEQ ID NO: 5620 - protein, 259 aa, Corynebacterium glutamicum
MYAEERRRQIASLTAVEGRVNVTELAGRFDVTAETIRRDLAVLDREGIVHRVHGGAVATQSFQTTELSLDTRFRSASSAKYSIAKAAMQFLPAEHGGLFLDAGTTVTALADLISEHPSSKQWSIVTNCLPIALNLANAGLDDVQLLGGSVRAITQAVVGDTALRTLALMRADVVFIGTNALTLDHGLSTADSQEAAMKSAMITNAHKVVVLCDSTKMGTDYLVSFGAISDIDVVVTDAGAPASFVEQLRERDVEVVIAE

SEQ ID NO: 5621 - protein, 320 aa, Corynebacterium glutamicum
MILTVTASPYLLSTNELDGTIEIGEANKIRQVSTVAGGFGTGVAATLFYGGNETFAVFPAPEISHYMRLVTFAGLPHEIIPVAGPIPMHLTMRDAEGNETKFKDSPMPLDVSQLAILRDLVVRRAEDAAWVLLGGNLPSIAPAAWFVDVVRSLRLYHPHVKVAIAATGAALRAVIRQLAATSPDALIVAAEEIEIATGLEPKTLRGPWVEGDLSPTVAAARALIDSGVTEVLVTNKRTESLYVSESESLLASYDSTPGKQGVNWRESFTAGFLAASNDGKSTEDSVINAVAYANAEGSEWDNYIPTPDKLRAEHVVIKSL

SEQ ID NO: 5622 - protein, 568 aa, Corynebacterium glutamicum
MATVADVNQDTVLKGTGVVGGVRYASAVWITPRPELPQAGEVVAEENREAEQERFDAAAATVSSRLLERSEAAEGPAAEVLKATAGMVNDRGWRKAVIKGVKGGHPAEYAVVAATTKFISMFEAAGGLIAERTTDLRDIRDRVIAELRGDEEPGLPAVSGQVILFADDLSPADTAALDTDLFVGLVTELGGPTSHTAIIARQLNVPCIVASGAGIKDIKSGEKVLIDGSLGTIDRNADEAEATKLVSESLERAARIAEWKGPAQTKDGYRVQLLANVQDGNSAQQAAQTEAEGIGLFRTELCFLSATEEPSVDEQAAVYSKVLEAFPESKVVVRSLDAGSDKPVPFASMADEMNPALGVRGLRIARGQVDLLTRQLDAIAKASEELGRGDDAPTWVMAPMVATAYEAKWFADMCRERGLIAGAMIEVPAASLMADKIMPHLDFVSIGTNDLTQYTMAADRMSPELAYLTDPWQPAVLRLIKHTCDEGARFNTPVGVCGEAAADPLLATVLTGLGVNSLSAASTALAAVGAKLSEVTLETCKKAAEAALDAEGATEARDAVRAVIDAAV

SEQ ID NO: 5623 - protein, 264 aa, Corynebacterium glutamicum
MVSQTERQHAIASLLAPTGAVSVGDLAEHFHVTTETVRRDLRIMESLGLLQRVHGGAISPEPMGTSPPRLKPALGKGMPPEPRVLELAETAVSLITPLARSIFLDSGLACTAIATVLGDPPEDARWTVVTSSPGAVIALSATDATSTVVLHGQVHGNCSSIIGSTAVDMISQLRADIAFVEVDAIQSDTSLCTFFPETIPIKQAMIKNAAFTVAVLSPRSPQDQELQLLKHPFSTLADFDALVTDDHTLDFPVLPDHNFQVVTP

SEQ ID NO: 5624 - protein, 330 aa, Corynebacterium glutamicum
MIITFTPNPSIDSTLSLGEELSRGSVQRLDSVTAVAGGKGINVAHAVLLAGFETLAVFPAGKLDPFVPLVRDIGLPVETVVINKNVRTNTTVTEPDGTTTKLNGPGAPLSEQKLRSLEKVLIDALRPEVTWVVLAGSLPPGAPVDWYARLTALIHSARPDVRVAVDTSDKPLMALGESLDTPGAAPNLIKPNGLELGQLANTDGEELEARAAQGDYDAIIAAADVLVNRGIEQVLVTLGAAGAVLVNAEGAWTATSPKIDVVSTVGAGDCALAGFVMARSQKKTLEESLLNAVSYGSTAASLPGTTIPRPDQLATAGATVTQVKGLKESA

SEQ ID NO: 5625 - protein, 612 aa, Corynebacterium glutamicum
MGFARLSKGVDFSGPDGDANLVFLIAAPAGGGKEHLKILSKLARSLVKKDFIKALQEATTEQEIVDVVDAVLNPAPKTTEPAAAPAAAAVAESGAASTSVTRIVAITACPTGIAHTYMAADSLTQNAEGRDDVELVVETQGSSAVTPVDPKIIEAADAVIFATDVGVKDRERFAGKPVIESGVKRAINEPAKMIDEAIAASKNPNARKVSGSGVAASAETTGEKLGWGKRIQQAVMTGVSYMVPFVAAGGLLLALGFAFGGYDMANGWQAIATQFSLTNLPGNTVDVDGVAMTFERSGFLLYFGAVLFATGQAAMGFIVAALSGYTAYALAGRPGIAPGFVGGAISVTIGAGFIGGLVTGILAGLIALWIGSWKVPRVVQSLMPVVIIPLLTSVVVGLVMYLLLGRPLASIMTGLQDWLSSMSGSSAILLGIILGLMMCFDLGGPVNKAAYLFGTAGLSTGDQASMEIMAAIMAAGMVPPIALSIATLLRKKLFTPAEQENGKSSWLLGLAFVSEGAIPFAAADPFRVIPAMMAGGATTGAISMALGVGSRAPHGGIFVVWAIEPWWGWLIALAAGTIVSTIVVIALKQFWPNKAVAAEVAKQEAQQAAVNA

SEQ ID NO: 5626 - protein, 89 aa, Corynebacterium glutamicum
MASKTVTVGSSVGLHARPASIIAEAAAEYDDEILLTLVGSDDDEETDASSSLMIMALGAEHGNEVTVTSDNAEAVEKIAALIAQDLDAE

SEQ ID NO: 5627 - protein, 194 aa, Corynebacterium glutamicum
MARTVSACGTCSFLYRKTTLIVDTQFEKIPAHDVVGIRVILSSEDLPELFKRGYAEVKKFLRLEGIEPKGPARAYYFGDVSDTVDILIGFPVSPAQAESLRRGALSQSGGDIDDVVLHHFRDMKTMHSRHSGPFDGVERVWDEILDEVEDLGCTLPSSSIGWEEYIEGPATADTCDQLASEVYVQVCQAPVKSA

SEQ ID NO: 5628 - protein, 429 aa, Corynebacterium glutamicum
MLVTSTWGWTVHGDGKKIEPGAVVAPKERLSWGRTIGIGMQHVIAMFGATLLVPTLTGFPVNTTLLFSGLGTILFLLITRNRLPSYLGSSFAFIAPLTATQVHGIGVQIGGILVAGLVLVAIGFVVKAAGKRVIDAVMPPAVTGAIVALIGLNLAPTAAGNFSSQPLVATATLFAILIATVAGRGMIARLGILIGVVIGWVFAAITGNLSEGAADTIREAAWFGLPQFHKPEFQLSAILVTLPVIIVLIAENVGHVKAVSEMTGEDLDDLAGDALIADGFGTTLAGAFGGSGTTTYAENIGVMAATRVYSTAAYWVAACTAIALAFIPKFGALIFTIPAGVLGGACLVLYGLIGMLGIRIWQDNKVNFNNPVNLTMAAVALVAGIGNLTLTVFGVTLEGIAWGSVGIIVLYPIMKRLYLSIGEGKNAKF

SEQ ID NO: 5629 - protein, 486 aa, Corynebacterium glutamicum
MRPGSDETSGFDLSGFIRAEEPSTGDLDLEARDAQRRRDTEIHADEAADGYEVEYRKLRLERVILVGVWTEGTTAEIDASLAELAALADTAGAEVIETLYQKRDKPDPGTYIGSGKVRELKEIIEATSADTVVCDGELSPSQLVALERELDIKVIDRTMLILDIFAQHAKSREGKAQVALAQMEYLISRVRGWGGNLSRQAGGRAGSNGGVGLRGPGETKIEADRRRLRSDMARLRRELSGLDTSRSIKRAQRAASLVPQIAIAGYTNAGKSSLINAMTGAGVLVENALFATLDPTTRKAELADGRHVVFTDTVGFVRHLPTSLVEAFKSTLEEVVEADLMLHVVDGSDPFPLKQIDAVNTVISDIVRSTGAVPPPEIIVVNKIDQADPLTLAELRHAVDDVVFVSALTGEGIKELEARIELFLNSRDAHLLLKIPFTRGDIVSRLHQHGTVLSEDYAEDGTLMDVRIPTQLAQELQSYVVEPTSA

SEQ ID NO: 5630 - protein, 262 aa, Corynebacterium glutamicum
MPVKGVRLIAMTSDLKTIGMDFAKWQDAVEAAIASQRLEVTGEVRGGQLIQFSDDSGAQINILAVEPFATFAGFNSATVAYGHVSMINDVLSLVDIIDPFGTPVATITCNLAQGPLLVDEPVQRWQQIRITALGIDVEVHDNADAYIRNGGETVGMLVSEGAEKIASGSGAVIPDASAEFSARVLSAEYRTNTLTGQRFIHATVDGLFAFDVCLPDAPELPARDSVLSGKVMLTAAVIPTEVTGCGGSGGGCGSGSCGCGGH

SEQ ID NO: 5631 - protein, 179 aa, Corynebacterium glutamicum
MGEQLPFANGSRSNKLPLIVIGLCCIMLILWLKLPGVLLATIIGVATMSVMRMRTSTPETASLVTSIRLSAEDISDVQHEWQQFLTSPEADALADRTLVRPALADPDCGDKAIEKFHYEISNANRFLGRLDARLQQNLVVSELETLLKVTDERALELRETWLDARKAAQKLGPNYNRES

SEQ ID NO: 5632 - protein, 277 aa, Corynebacterium glutamicum
MNLTIPFAKGHATENDFIIIPDEDARLDLTPEMVVTLCDRRAGIGADGILRVVKAADVEGSTVDPSLWFMDYRNADGSLAEMCGNGVRLFAHWLYSRGLVDNTSFDIGTRAGVRHVDILQADQHSAQVRVDMGIPDVTGLSTCDINGQVFAGLGVDMGNPHLACVVPGLSASALADMELRAPTFDQEFFPHGVNVEIVTELEDDAVSMRVWERGVGETRSCGTGTVAAACAALADAGLGEGTVKVCVPGGEVEVQIFDDGSTLTGPSAIIALGEVQI

SEQ ID NO: 5633 - protein, 301 aa, Corynebacterium glutamicum
MVTPIAVVGPTASGKSALGIALAHKLDGEVVNVDSMQLYKGMDIGTAKLTVEEREGIAHHQLDVWDVTETASVARFQSDAVADVEDIMSRGKTPILVGGSMLYVQSLVDDWQFPPTDSAVRARFEARLADIGVEALHAELTQLDPEAAAVIESNDPRRTVRALEVIELTGQPFQASQPPKDAPPRWGTRIIGLKTTPEWLNPRIEQRTARMFEQGFVAEVEHLVQQGLIADSTAGRAIGYSQVLAAMAGEMTWEDAFERTVTGTRRYVRRQRSWFNRDHRVSWVDASGDPTAQALEILGLQ

SEQ ID NO: 5634 - protein, 225 aa, Corynebacterium glutamicum
MKNRAQERCLPSNFGGQDRVEDVNATLIIMPGSPALVPELAPADAAGARLLASLRAVFDAELANDDRPIELVGSRDEAWFTKHAGNLRAWGAPSVQVSDGHYLPEILQRVALGGFESRVTHVRDRLGSVNDNTVTVLALDGPTGLTTRAPSALVPGASNIDAWCRSLLSGKPGEVPSTSTLIDASLREPQLWLDLSAVATEASTAQLLDSDDTHGVGRYVARWTF

SEQ ID NO: 5635 - protein, 453 aa, Corynebacterium glutamicum
MTENQTPSSTSAPKPGPRPGPRPGPRPGAQVAAKKAAVATPAPIAKTSNDPAKFGRVEADGSAYVTTSAGERLIGSWQAGTPEEGLAHYGARFDDLATEVELMEQRLISHPDDATSIRTKAEELKATLPTIAAIGDLDGVEARLSKIINNSEEANERAKEQKAKNRERAVARKEELAVEAETLAENSSDWKVAGDRIRAILDEWKSIHGIDRKTDDELWKRYSRARDSFNRRRGAHFAELDRTRASARKLKEELVERANALKESTEWNDTARAFRDLMTEWKAAGRAPREIDDKLWAAFKGAQDYFFDKRNAVAKERDQEFEANATAKQQLIDEYDAQINPEQGLDGARSKLRELQEKWEEIGFVPRGVVREFEEKIAVLEKRVSAAEESQWRRTDPEAQARADQFSAKVAEFNAQADAAEAKGNSKKAEKLRAQAAQWAEWSRAAHEAVDQL

SEQ ID NO: 5636 - protein, 340 aa, Corynebacterium glutamicum
MCGAGPFCPLCSLCAQLLSLLGVALGFGGVCLSVELGDLRGELVCACLCFWVGAAPLGFLSSGDALFQHGDLLFEFADNATWNEADFFPLFLQFAELAARSIEALLGVDLCVVFVDELLLCGCVGFEFLVAFLGYGVALIKEVVLGALECCPQLVVDFAWCAAGGFPFGHEIAECAGGVVPLSGFLESIGALNEFFLEFACRCAGAIQLCEVCAAATVEGVTRTGVAFPQFIIGLAVDAVDGLPLIQDGADAVASNLPVGGVFCQGFSLNSELFLASYCALTVFSLLFLGALVGFLGVVDDLGQASFNAIKVTDRSDGGQGCLEFFSLRADGGRIIRVGD

SEQ ID NO: 5637 - protein, 341 aa, Corynebacterium glutamicum
MKFSKLADQVWGEEPDDQVRSFVFMSNLDAQETANTMDVSVSVERIHADLCGNTELASELHYTPDEWDEAQGWVKINYPLIDDTASASLDVVLDATFQPLPGQPFEGEALTLIDALLHHAENVAASNPWKRTTFHTAHMHPPGSNADCDYCLVLQRRGYVKAHEEIQQTIPLPSGDWSAGEFTVVDVEGTAFPSALIPSIVELQHRAALDVPHGNLSVAPAQWDEHRLAQQSERILKTGTKLFTVLFAEGSTVAAMSSIAIPPGSNPDIAEQGLTIVHPDFRGRGLGTAVKLAGLSLLSRCHPEIQRVATSNAVDNHAMLAINRSIGATEIARTTLWEKKL

SEQ ID NO: 5638 - protein, 223 aa, Corynebacterium glutamicum
MNNNVSDQKLSGKELAALEKQAAKTLELGDKKWYLIAGVVLFAIALVLPHIRGVMGWQVLTLSNVAEDAGITLGEYGFYWLGTIGVFLLSLGTVVFKRTWMAWISWIFSCVTLVFAVFAIWMRQTTTSTQVNFVNIGMMLAVIAAILAVWGLSSVILARSDRQMEIAEMRAENPDLDGVAATQRALLEQQQSNPEDNPLLVDDRRARIARRREREQDAQGEQA

SEQ ID NO: 5639 - protein, 522 aa, Corynebacterium glutamicum
MNHAKVNQHPGQATLPETAEGQVRTYEVKTYGCQMNVHDSERLSGLLEEAGYVAAPEDTTPDLVVFNTCAVRENADMRLYGTLGNLRSVKEKNPGMQIAVGGCLAQKDKDTVVKKAPWVDVVFGTHNIGSLPTLLQRAEHNAQAEVEIVDSLEQFPSVLSAKRESAYAGWVSVSVGCNNTCTFCIVPSLRGKEQDRRPGDILAEVQALVDQGVTEVTLLGQNVNAYGVNFVDPELERDRSAFSKLLRACGEIEGLERVRFTSPHPAEFTSDVIDAMAETPNICPQLHMPLQSGSDKVLKEMRRSYRSKKFLSILDEVRAKIPHASITTDIIVGFPGETEEDFQATLDVVKKARFTSAYTFQYSPRPGTPAAEYENQLPKEVVQERYERLMVVQEQVCEEENQKLIGTTVELLVQAGGGRKNDATKRMSGRARDGRLVHFAPEGDIDGEIRPGDFVTVTVTEAKPFFLIADSGVQTHRRTKAGDNSAVGQVPTTAPIGVGLGLPQIGAPKVAPATESACCSIN

SEQ ID NO: 5640 - protein, 242 aa, Corynebacterium glutamicum
MIKMTGVQKYFGDFHALTDIDLEIPRGQVVVVLGPSGSGKSTLCRTINRLETIEEGTIEIDGKVLPEEGKGLANLRADVGMVFQSFNLFPHLTIKDNVTLAPIKVRKMKKSEAEKLAMSLLERVGIANQADKYPAQLSGGQQQRVAIARALAMNPKIMLFDEPTSALDPEMVNEVLDVMASLAKEGMTMVCVTHEMGFARKAADRVLFMADGLIVEDTEPDSFFTNPKSDRAKDFLGKILAH

SEQ ID NO: 5641 - protein, 73 aa, Corynebacterium glutamicum
MSPSAMNNTRSAALRANPISWVTHTIVMPSLARLAMTSNTSLTISGSRAEVGSSKSMIFGFIASARAMATRCC

SEQ ID NO: 5642 - protein, 228 aa, Corynebacterium glutamicum
MSTLWADLGPSLLPAFWVTIKLTIYSAIGAMIFGTILTTMRVSPVKILRTLSTAYINTVRNTPLTLVVLFCSFGLYQNLGLTLAGRESSTFLVDNNFRLAVLGFILYTSTFVAESLRSGINTVHFGQAEAARSLGLGFGATFRSIIFPQAVRAAIVPLGNTLIALTKNTTIASVIGVGEASLLMKATIENHANMLFVVFAIFAVGFMILTLPMGLGLGKLSERLAVKK

SEQ ID NO: 5643 - protein, 273 aa, Corynebacterium glutamicum
MLSGNGQLDANKWTPFINSQTWTTYILPGLWGTLKSAVFSVILALVMGTALGLGRISEIRILRWFCAVIIETFRAIPVLILMIFAYQMFAQYNIVPSSQLAFAAVVFGLTMYNGSVIAEILRSGIASLPKGQKEAAIALGMSSRQTTWSILLPQAVAAMLPALISQMVIALKDSALGYQIGYIEVVRSGIQSASVNRNYLAALFVVALIMIVLNFSLTALASRIERQLRAGRARKNIVAKVPEQPDQGLETKDNVNVDWQDPDYKDLKTPGVQ

SEQ ID NO: 5644 - protein, 199 aa, Corynebacterium glutamicum
MDIQAEKIEKLRKALDNFERAHARGESDFFDHEKEEKKANVRRRALLLLNQRARSVNELSTRLKALEFEEDIINEVIGDLTRSKLLDDEVFATEWVRQRAARRGKSSRALDRELQEKGVDKQTRAAALEQIDQADERDTARAVAVKKARSETKIPQDRADYDKALRRVVGALARRGFPAGMSMDLAREALDARIEDLKN

SEQ ID NO: 5645 - protein, 78 aa, Corynebacterium glutamicum
MRCIIVPMRLSEFRQLIEDEFGEAKGEWIAHSHVIGALGVTADVAVDTGVDLRDVWEQLCIDFSVPEERRLGKDEPGF

SEQ ID NO: 5646 - protein, 246 aa, Corynebacterium glutamicum
MCQWSIFVNLLKSYKRSARNMNFDPVGKWVAANIRCDVDESPVTRDEVLGICMKLRSGKPKLEYRISGSVEDFGEESTRFSFRCNPQTGAQHKVTTYANGESRESFDTPKLTSEGWFESDQFIIRPRGAPGLMVMWKDFVMHELYSPPPPNGFSMTMHNLRYLKITQDLTDEDAGWGLFVDLETDCALYYCQYVEEHTMFKETVVSSVHVLFSGETSFHEFERNDVGELTRVDSSALEDGHDGDPS

SEQ ID NO: 5647 - protein, 192 aa, Corynebacterium glutamicum
MTPLKKQSSRKQLQDIALIAVFAALIIVLAFVSIPVGTAGVPIVLQNASIVLAGLILGGRRGFLTALLFLALGLIGLPVLAGGRTTLAALAGPTAGYIVGYLISPLVAGIIAYLAPKKRGAGMFIVLGLAGLAGLITQYACGIVGLVLRAGLSLSEATIAQGAFVLPDLAKITVMVIIAAGVHAAFPDIRKK

SEQ ID NO: 5648 - protein, 233 aa, Corynebacterium glutamicum
MQFMPEIIFDNTEVRYDDSLILEPLSLKLTEQRIGIIGANGGGKSTLIRMINGLGEPTTGRVLVDGLDVSHSGREVRKKVGFVFSDAENQIVMPTVREDIAFSLRRHKMPRAEKAQRVDEMMARFNLSEHADQSPHTLSGGQKQLLALAAVLILEPEVIIADEPTTLLDLRNRLMIKDVFNKLEQQLIVVSHDLDFLSDFERVICINDHKIAADGPPQKSIDLYVSLMAEPAK

SEQ ID NO: 5649 - protein, 203 aa, Corynebacterium glutamicum
MNSIPLGFYVDKQSVVHSFPALWKFPLLLFFIIGGSIAASTPVHGLILVGIAVVFYVLAKIPLKVAWEQLWPVLPILIMLGAFQWWQRGFDFAATTVLTLFSAVMAAMLLTLTTRLEALMNAVERMLQPFARFGLPVETITLAISLTIRLIPLQLATVKEVLDARKARGAGFSIAAFGTPVIIRSIKRARNIGDALLARGAGD

SEQ ID NO: 5650 - protein, 230 aa, Corynebacterium glutamicum
MSSHLNASLLNLSHAALNRVGRKLSLAKRVSVTTLNLLTNLIQVRSAAGGQRIHGLQGLGNLFLHLRLLQLAQKLGALSNLLLQSHGVTLHSLLSLISLLQSLVVELLGIFNGLLSSNQLCSESLSGVFVLSSLLDITVSASLVSQLDSLAGVALQLLNFSQTAVQLHFKLTLVTNNSCCLLGELLMLALSIFDGLLDLYLRIRVLLNLGVEQRHEVLPCLGEWISHVEK

SEQ ID NO: 5651 - protein, 276 aa, Corynebacterium glutamicum
MANPFSKAWKYLMALFDSKIEENADPKVQIQQAIEDAQRQHQELSQQAAAVIGNQRQLEMQLNRRLAEIEKLQGNTRQAIQLADKARADGDVKKATEYENAAEAFAAQLVTAEQSVEDTKQLHDQALQQADQAKKAVERNSMALQQKVAERTKLLSQLEQAKMQEKVSESLKSMDSLTSGSTPNLDQVREKIERRYANALGQAELASNSVEGRMAEVEQAGVQMAGHSRLEQIRAEMAGGSLTAGNKQESIEAPAAGNNVTDDAVAQRMRELRGEA

SEQ ID NO: 5652 - protein, 107 aa, Corynebacterium glutamicum
MVTYTTLLDKPISESAPRKAPEPLLREALGAALRSFRADKGVTLRELAEASRVSPGYLSELERGRKEVSSELLASVCHALGASVADVLIEAAGSMALQAAQEDLARV

SEQ ID NO: 5653 - protein, 172 aa, Corynebacterium glutamicum
MSENLAGRVVELLKSRGETLAFCESLTAGLASATIAEIPGASVVLKGGLVTYATELKVALAGVPQELIDAHGVVSPQCARAMATGAAHRCQADWAVSLTGVAGPSKQDGHPVGEVWIGVAGPAHFGASGTIDAYRAFESEQQVILAELGRHHIRESAVQQSFRLLIDHIESQ

SEQ ID NO: 5654 - protein, 201 aa, Corynebacterium glutamicum
MSDVSAGVNGAQDPSNQAVKPSNWNLPNFLTSLRIIVIPLFAWLTLKGETENNAFAWWALVVFILLMITDKLDGDIARARGLVTDFGKIADPIADKALMTTAFVCFNIIGILPWWVTALIVLREFGITIWRFFQLRAGNVVPASKGGKLKTALQTVAVALYLCPFPSWMDIPSQIVMYAALIVTVVTGLQYLWDSRKSAES

SEQ ID NO: 5655 - protein, 95 aa, Corynebacterium glutamicum
MTYFAVLYTYNPDSEKVAEVRTVHREFIANLHAEGKIVGSGPFVDGDGGALIVIKLEEGSNLVDAETLMNNDPFHVENVLDNRVIRSWNPVTKDF

SEQ ID NO: 5656 - protein, 39 aa, Corynebacterium glutamicum
MALGLYESQVPSRLPKPALLPKPALLPKPALLPKPASYG

SEQ ID NO: 5657 - protein, 271 aa, Corynebacterium glutamicum
MQTKLCTNEQQDKTQAIRQVDQAVKQAVKQEVHLAQTQQGECVSGEHDVRLRGDAVNRWDRVQCEHQVNHADGYKCNEQWGQVQLASEAVSELVAVVALSNRNDLAQRLNDEHVVRVGLRGVSNFVPQELHSGVDQPDGEDVEDIGPGFDNCSTCEDECQAEDQCQRDTDEQNLLLVLARNLERTHDQREDEEVINTQRLLCHVTGEELNAVLVWVTWLAPSKPEEHAENTGEGYVEEAPPCGFFDSGLVWGADVGIEIENEEASNHCDSD

SEQ ID NO: 5658 - protein, 369 aa, Corynebacterium glutamicum
MEVNLATWLITIAVIAGFFIFDFYSHVRTPHEPTIKESAWWSLFYVALACVFGVFLWFAWGEPGNPHQHGIEFFTGYVTEKALSVDNLFIFALIMGSFKIPRKYQQKVLLIGIALALVFRLAFILAGAAVIEAWSDVFYIFSIWLIYTAVKLLWDEVRDTPETDPNDMFIIKALRKVIPVTEGYHGDKLTHRFGGKLHLTPLFVALVSIGMVDLMFALDSIPAIYGITTEPYIVFTTNAFALLGLRQMYFLLDGLLDRLVYLPYGLGLILLFIGAKLGLHALHENNLPFINGGENVSVPEVSTVFSLVFIIGVLTITVIASIIKNKRDENQGGIPPKWNAAKYEGDNWETGEEPETGSATVTDISSEKK

SEQ ID NO: 5659 - protein, 921 aa, Corynebacterium glutamicum
MTRSIGELGRRRNEDVLDDFDDFEEEIATKPATRKSRSKAVEPEPEFDEDFDEQSGNRTSAYVEEHADGIALSLVGIAIVLGAAVWLGIGGPIGTFIADIVHLAIGAGAWILPVGLIGWAVALMLRYTPERQAQGRVMLGIGVIIVCMLALIHLFAGNPAEWEGRKTAGGAIGAWIGTPLELGFSVFLAVPILLLLLFWGALKTTGISIREFIEFAGGFFGFAGFNRDEDEFDEEDDDLYGHVERELESRASGRAPSRTPSRALPKAAPRRTPPLTPPPAPVPAPAPTPARRPAASLDKYPVDDAKAEAPAEPQVKQREASTSILKKPSVTETDEFPAVTEEDLAPAPASDAVAASRESMRQAIIARSGKDPVVEKKPAAPAPVAPTPADIVSDGDSTYVLPSADLLIPGEPAKLHSETNDRMIEAITDVFSEFNVDATVTGFSRGPTVTRYEIELGPGVKVSKITNLQSNIAYAVATENVRLLTPIPGKSAVGIEVPNSDREMVRLGDVLNARATVENKDSMLIGLGKDIEGDFVSYSVQKMPHLLVAGSTGSGKSAFVNSLLVSLLTRAKPEEVRLILVDPKMVELTPYEGIPHLITPIITQPKKAAAALQWLVEEMEQRYMDMKQTRVRHIKDFNRKIKSGEIETPPGSKREYRAYPYIVCVVDELADLMMTAPKEIEESIVRITQKARAAGIHLVLATQRPSVDVVTGLIKTNVPSRLAFATSSLTDSRVILDQGGAEKLIGMGDALFIPQGAGKPQRIQGAFVTDEEIQAVVDMAKAQRQPEYTDGVTEDKASEAKKIDADIGNDLEDLLEAVELVVTSQMGSTSMLQRKLRIGFAKAGRLMDLMETRGVVGPSEGSKAREVLVKPEELETILWMLKGADPADAPKEETWDDEVAAEAEEAANTTVVQADPSKGVC

SEQ ID NO: 5660 - protein, 211 aa, Corynebacterium glutamicum
MNLAQTERAALQASLLEKGPDAPTLCGEWTTKDLAAHLYVREQKPGAALRSMLPGKQDPAKEEFEEALTRPYEDVVNAWAEGPQGLNPWRALDSIGNSMEHFIHHEDVLRGALQPGDEVEVRPMEHAHGKELHRILKLLAPRMIKSPRPVVLAPVGFPRIVLHEGRGVSADGENVCRISGGVGELLLWLSGRDVVKLTFEGNQEGVVRGSL

SEQ ID NO: 5661 - protein, 718 aa, Corynebacterium glutamicum
MNDSRNRGRKVTRKAGPPEAGQENHLDTPVFQAPDASSNQSAVKAETAGNDNRDAAQGAQGSQDSQGSQNAQGSQNRESGNNNRNRSNNNRRGGRGRRGSGNANEGANNNSGNQNRQGGNRGNRGGGRRNVVKSMQGADLTQRLPEPPKAPANGLRIYALGGISEIGRNMTVFEYNNRLLIVDCGVLFPSSGEPGVDLILPDFGPIEDHLHRVDALVVTHGHEDHIGAIPWLLKLRNDIPILASRFTLALIAAKCKEHRQRPKLIEVNEQSNEDRGPFNIRFWAVNHSIPDCLGLAIKTPAGLVIHTGDIKLDQTPPDGRPTDLPALSRFGDEGVDLMLCDSTNATTPGVSGSEADVAPTLKRLVGDAKQRVILASFASNVYRVQAAVDAAVASNRKVAFNGRSMIRNMEIAEKLGYLKAPRGTIISMDDASRMAPHKVMLITTGTQGEPMAALSRMARREHRQITVRDGDLIILSSSLVPGNEEAVFGVINMLAQIGATVVTGRDAKVHTSGHGYSGELLFLYNAARPKNAMPVHGEWRHLRANKELAISTGVNRDNVVLAQNGVVVDMVNGRAQVVGQIPVGNLYVDGVTMGDIDADILADRTSLGEGGLISITAVIDNRTGRLLERPTVQTSGFSEDAKSMMGEVTELSETTMNDLAAEGENDPYRMVQQLRRKLSRFVEQKWKRQPVIMPTVIPMTAETTHIGDDEVRASRESL

SEQ ID NO: 5662 - protein, 250 aa, Corynebacterium glutamicum
MAEQVKLSVELIACSSFTPPADVEWSTDVEGAEALVEFAGRACYETFDKPNPRTASNAAYLRHIMEVGHTALLEHANATMYIRGISRSATHELVRHRHFSFSQLSQRFVHSGESEVVVPTLIDEDPQLRELFMHAMDESRFAFNELLNALEEKLGDEPNALLRKKQARQAARAVLPNATESRIVVSGNFRTWRHFIGMRASEHADVEIREVAVECLRKLQVAAPTVFGDFEIETLADGSQMATSPYVMDF

SEQ ID NO: 5663 - protein, 233 aa, Corynebacterium glutamicum
MRLKLPFTARSAGSSLALVVSASLLLSACDGSGSTPTTSASPAPVVTETETANPVTTTRTPSDAAPSPTTSEPTGSESTNSPSPTALPPLGSPSMDQKQQAQVGDSDMSIAGIRVAEHETFTRVVFDIAGNGQPGWWVDWATDPIQQASGLPVEMAGDSFLNVNIQGTGYPDQVVVPGIDTGSYPGAGIVEDINFTSIFEARSQVLIGVSGQPRNYSVSLLQEPTRLVVDIVH

SEQ ID NO: 5664 - protein, 88 aa, Corynebacterium glutamicum
MGEGELVDSEPVGSEVVGDGAASEGVRVVVTGLAVSVSVTTGAGLAEVVGVEPLPSQALKSKEAETTSAKELPAERAVKGNLSLIFQT

SEQ ID NO: 5665 - protein, 753 aa, Corynebacterium glutamicum
MSDVKYFEDTEFGLIEAVATIDNGDFGTRTIRFETGQLARQADGAVTTYLDDDTMLLATTTASNQPREGFDFFPLTVDVEERMYAAGRIPGSFFRREGRPSTEAILACRLIDRPLRPTFVKGLRNEVQIVVTVMSMNPEDYYDVVAINGASAATRISGLPVSGAVGGVRMALVVDEKHPEGQWVAFPTHAQHEQSVFEIVVAGRLVERKRGNKTFSDVAVMMVEAGASENVVNRVKDGAPAPTEKIVSDGLEAAKPFIDILCRAQEGLAQRVGNAAKEFPLFPPYTDEVYSAVERKVSKKLASLLTLKAKQERDDATNAYMEEIEAELLPKFEASYSSAAEASKEIRAGYNAVMKAIVRRMILTDHFRIDGRGVTDIRDLAVEVELIPRAHGSSLFERGETQILGVTTLDMLKMEQQIDSLAPGDAKRYMHHYNFPPYSTGETGRVGSPKRREIGHGALAERAVLPVIPSREEFPYAIRQVSEALGSNGSTSMGSVCASTLSLYNAGVPLKAPVAGIAMGLVSGEIDGKTEYVALTDILGAEDAFGDMDFKVAGTADFITALQLDTKLDGIPSKVLSDALEQARDARLTILNTMADVINGPDEMSKFAPRITTVKIPVAKIGELIGPKGKNINALTEETGANISIEDDGTVFISAADGASAEAAIEKINALANPQLPKVGERFLGTVVKTTAFGAFVSLLPGRDGLVHISKLGNGKRVEKVDDVVKVGEKIQVEIADIDNRGKISLVPVVEED

SEQ ID NO: 5666 - protein, 89 aa, Corynebacterium glutamicum
MALTSEQKKSILSEFGLHETDTGSPEAQIALLTNRINNLTEHLKFHKHDHHSRRGLLLLVGRRRGLLKYLADNNVDRYRDLIARLGLRR

SEQ ID NO: 5667 - protein, 316 aa, Corynebacterium glutamicum
MSKKAILDIDTGIDDALALAYALGSPELELIGVTTTYGNVLLETGAVNDLALLDLFGAPEVPVYLGEPHAQTKDGFEVLEISAFIHGQNGIGEVELPASESKALPGAVDFLIDSVNTHGDDLVIIATGPMTNLSAAIAKDPSFASKAHVVIMGGALTVPGNVSTWAEANINQDPDAANDLFRSGADVTMIGLDVTLQTLLTKKHTAQWRELGTPAAIALADMTDYYIKAYETTAPHLGGCGLHDPLAVGVAVDPSLVTLLPINLKVDIEGETRGRTIGDEVRLNDPVRTSRAAVAVDVDRFLSEFMTRIGRVAAQQ

SEQ ID NO: 5668 - protein, 341 aa, Corynebacterium glutamicum
MDIWSGLDSVPADLQGSVVTIGVFDGLHRGHQSLIGEAKKQAEELGVPCVMVTFDPHPIAVFLPGKEPTRLAPLDYRLNLAAECGVDAALVIDFTKELAGLSAEEYFTTMIVDTLHARSVVVGENFTFGVNGAGTESTMRELGQKFGVNVTIAPLLHDDDQRICSTLVRDYLDQGEVERANWALGRRYAVRGEVVRGAGRGGKELGYPTANLYLPTSVALPADGVYAGWFTITDDREIDKEISRDIDGTMVPGVRYQTAISVGTNPTFGDERRSVEAFILDQEADLYGHHVMVEFVGHLRDMVKFNGVDELLDAMARDVTNARDILAKDKLLLDADTQPSA

SEQ ID NO: 5669 - protein, 297 aa, Corynebacterium glutamicum
MNAPAPKPGLVIVDKPAGMTSHDVVSKLRRAFSTRKVGHAGTLDPMATGVLVVGIERGTRFLAHMVASTKAYDATIRLGAATSTDDAEGEVISTTDASGLDHSTILAEIVNLTGDIMQKPTKVSAIKIDGKRAHERVRDGEEVDIPARPVTVSVFDVLDYHVDGEFYDLDVRVHCSSGTYIRALARDLGNALQVGGHLTALRRTEVGPFTLNDATPLSKLQENPELSLNLDQALTRSYPVLDITEDEGVDLSMGKWLEPRGLKGVHAAVTPSGKAVALIEEKGKRLATVFVAHPNTL

SEQ ID NO: 5670 - protein, 76 aa, Corynebacterium glutamicum
MVEATMCARKRVPRSIPTTNTPVAMGSRVPAWPTLRVENARRNLDTTSWDVIPAGLSTITSPGLGAGAFMSVESMP

SEQ ID NO: 5671 - protein, 217 aa, Corynebacterium glutamicum
MLDESLFPNSAKFSFIKTGDAVNLDHFHQLHPLEKALVAHSVDIRKAEFGDARWCAHQALQALGRDSGDPILRGERGMPLWPSSVSGSLTHTDGFRAAVVAPRLLVRSMGLDAEPAEPLPKDVLGSIARVGEIPQLKRLEEQGVHCADRLLFCAKEATYKAWFPLTHRWLGFEQAEIDLRDDGTFVSYLLVRPTPVPFISGKWVLRDGYVIAATAVT

SEQ ID NO: 5672 - protein, 268 aa, Corynebacterium glutamicum
MTTTLWAVSDLHAAVKANADPIENIQPKDPSDWLIVAGDVAERTELVLEILARLRRRFAKVIWVPGNHELFSRSADRYQGRDKYSELVEGCRKIDVLTPEDPYLTFGGVTIVPLFTLYDYSFRRPGFTVEQAVQAARDRQVMMTDEFSIAPFVDIRAWCWDRLAYSIKRLSKINGPTILINHWPLVVEPTYQMRWQELALWCGTRHTRGWAERYNAEAVIYGHLHMPGITNVNGVKHIEVSLGYPREWEHWSGQHVWPYPVMEVDNAG

SEQ ID NO: 5673 - protein, 435 aa, Corynebacterium glutamicum
MSNNDFEHESHDVSAKQIFGLAFPALGVLAAMPLYLLLDTAVVGTLGGFELAALGAATTIQAQVTTQLTFLSYGTTARSSRIFGMGDRRGAIAEGVQATWVALFVGLGILTLMLIGAPTFALWLSGDEALAQEAGHWLRVAAFAVPLILMIMAGNGWLRGIQNTKLPLYFTLAGVIPGAILIPIFVAKFGLVGSAWANLIAEAITASLFLGALIKHHEGSWKPSWTVMKNQLVLGRDLIMRSMSFQVAFLSAAAVAARFGTASLAAHQVLLQLWNFITLVLDSLAIAAQTLTGAALGAGTAKVARRVGNQVIKYSLIFAGGLGLVFVVLHSWIPRIFTQDADVLDAIASPWWIMVAMIILGGIVFAIDGVLLGAADAVFLRNASILAVVVGFLPGVWISYALDAGLTGVWCGLLAFILIRLFAVIWRFKSMKWAR

SEQ ID NO: 5674 - protein, 332 aa, Corynebacterium glutamicum
MTDNSQFHAASALVQAAHTVSVVGHLRPDADAIGSVAATVAALQQLGKDAVGAIGQLDSMPENLYTIPGASNIKFGDSLPESDLIIVVDCGSIERTGAFESIIVNNPDKVLVVDHHATNPGFGAVNLIDVEAESTTTILYDWFDAMSVQITPDIAHGLYAGLLTDTGCFRWGRPVMHDMAKELMEFGLDIRAISSALLDQTSVDDLRLVGQIVSRIELREAGPYTLAVLVADFDTINGRSRAVVEGLIEMVRAVEGADFGAVFKEYERGVYTVSLRSSNLSVASLAVHLGGGGHIPAAGYTARGTEIEALDTLIEATVTLGESLRSSAHVDV

SEQ ID NO: 5675 - protein, 149 aa, Corynebacterium glutamicum
MADNARAARMAKRIQTIVASAIERDIKDRRLEFVTITDVTMTGDLHDAKVFYTVRGASIEEEPDLEAAAEALHRARGQLRKIVGQQLGVRFTPTLTYSIDTVPEASAHMEALLDRARKRDEELAKLREGAAPAGDADPYKTSSKSESEE

SEQ ID NO: 5676 - protein, 1004 aa, Corynebacterium glutamicum
MPGKLRVHELAKQLGITSKELLATLKDKGEFVKTASSTIEPPVVKRMQEHYGSSGSDKSDTAAKPAAAKPAAPKPAASAAPKPGAPAKPAAPAAKPAPAAPSAASAAKPGAAPKPGVQAKPAAAAKPGAPAKPAAPAAPSAAKSGSAPKPAAAAKPAFSGPTPGDAAKKAEPAAKPGAEAPRPGGMPRPMGKPAPKPGARAPRVANNPFSTGGGERPAPRPGGGPRPGGGPRPGGGPRPQGQGRPGGQRDGQRDGQRDGQGNRGGQRQGAGAGGPRPQGGPRPQGGSRPQGGSAQGAQGAPSQERQGGGRRPSPAMMPPTPGQMPAKAPGKGGRGGQAGGGAGGGFNRGGGTGGGAGRGGRRGGTAGAFGRPGGAPRRGRKSKRQKRNEYESMQAPNVIGGVRLPDGKGATIRLARGASLADFADKIGADAAALVQALFNLGEMVTATASVSDETLQLLGEEMNYKVQVVSPEDEDRELLESFDLQFGEDEGGEADLAKRPPVVTVMGHVDHGKTRLLDTIRKANVGSDEAGGITQGIGAYQVKVNVEDTERTITFLDTPGHEAFTAMRARGAKSTDIAVLVVAADDGVMPQTVEAINHAKAADVPIVVAVNKIDKPEASPEKIRGQLTEYGLIPEEYGGDTIFVDISAKQGLNIDELLASVCLTADAELDLVANPEMDAQGVAIEAHLDRGRGPVATVIVQRGTLRVGDSIVAGDTYGRVRRMVDEYGRDVEEAGPSRPVQVQGLNGVPGAGDNLLVVEDDRIARQIANQRNARKRNALAARSRKRVSLEDLDSVLKEHSTLNLILKGDNAGSVEALEEALLKIEMDDEVQLNIIDRGVGAVTQTNVTLAAASDAVIIAFNVRAEGKATEEANAEGVDVRYYTIIYRAIEEVEAALKGMLKPIYEERVIGHAEIRAIFKASSVGLIAGCMVEDGKVRRNATVRIIRDGNVIAENAKIVSLRREKDDATEVSAGYECGMVLSYPDISVDDKIEVYEMVEVPREA

SEQ ID NO: 5677 - protein, 112 aa, Corynebacterium glutamicum
MFHDDALKASSGQLSRFNPIRIRTCIATRERKPDSELLRVVQSPELPGVILPDPKRRMPGRGAWLTPSIDALDLAEQRRAFGRALRVSTTVDTGHVRTYLAENAGPDFCKED

SEQ ID NO: 5678 - protein, 332 aa, Corynebacterium glutamicum
MNIDVQALKAIESEKGIPVPDLLRTIASALLHSYMDNRETVASANLKPRVDIDSTTGTVNVIVSEFDENGELASEYDDTPSNFGRVSARAVRDAIVKSLREAEASRAFDAYADYEGTVVSGIVQADARAAERGIIIVQLGTEADNQDGVLLPAEQIPGEKLKHGDRVKCFVVGVGKGNTDIQINLSRTHPELVRRLFELEIPEVADGSVEIVAISREAGHRSKVAVQAKVKNLNAKGACIGPRGQRVSNIMRELGGEKIDIIDYSEDPATFVGNALAPSKVVNVEVTDLEAQTARVTVPDYQLSLAIGKEGQNARLAARLTGWKIDIHSDID

SEQ ID NO: 5679 - protein, 418 aa, Corynebacterium glutamicum
MSFGVVKRPDACYALFAILIKRNQATAVSAPMARQRQWVVHARRGHFERVTRSEVELSALLGGVEKLSDFLAEYFQLVEIGAGIRIYLDGDGGFWTCFGHFQALEVEFVGCGERLDERRQNFSGWKSHKDKDNLPAKIIGLLHCEAMRRRIPSVLGVSLLAAFLVACTPSPNPNAALAQMYQDALFDSQAMSEAEPELATLRSQHADELLAEIRRICGFDEGQVPESCQVTVPAIAILPTDDPEKYVNDSQALILDNLDDIPEDSVALVVEQYIAQAEFAEGSEVSVPVDLELTEAELAAAKDLADREFSAAWSLGVALAQLPETDREEVETAISNHHDRASQLQIITSGTTPAPGYVSELPDPTDETSARSNIETVENNVTQAWHAAASAATTDAWRVFCAHIAGDTARELTLIDVS

SEQ ID NO: 5680 - protein, 178 aa, Corynebacterium glutamicum
MAFPTTEILSALIEPLAASHKFDLEGLKVTKAGPKSAVAIKVDSDSRPDLDQLEVFSQEIGELFDAAEQRGELNFGAGYTLEVSTPGVDNPLTLPRHWRRNRGRLVALDQDGKKRVARIGALNDAETHVVLIERNKKLLEVTTLELAHSPRAVVEIEFAKPAQDETALAESTFDEATA

SEQ ID NO: 5681 - protein, 534 aa, Corynebacterium glutamicum
MTLKKSLAVTTAAALALSLAACSSDSSSDSSSSSSGSEGGDNYVLVNGTEPQNPLVPGNTNEVGGGRIVDSIFSGLVYYDVDGSPVNDVAESIELEGDKTYRITIKDGQTFTDGTPVTAESFVNAWNYNVANSTLSSYFFESILGYEEGVESMEGLQVVDDTTFTVELTQPESDFPLRLGYSAFFPLPESAFDDMDAFGENPIGNGPYKLQEWNHNQDATIVPNADYTGGRQAQNDGVKFIFYPTFDSAYADLLSDNLDVLDAIPDSAFSSFEDELSGRSINQPSAVFQSFTIPESLEHFSGEEGVLRRQAISLAVNRDEITQTIFEGTRTPATDFTSPVIDGHSDSLQGADVLTYDPERAQELWAQADEISPWSGEFSISYNADGGHQAWVDATANSIRNTLGIDAIGNPYPDFKSLRDDVTNRTINGAFRTGWQADYPSLGNFLGPLYGTGAGSNDGDYSNPDFDAKLAEAANAADVDASTPLYNEAQEILLQDLPAIPTWYSNAVGGYSTNVDNVEFQWNSQPAYYQITKN

SEQ ID NO: 5682 - protein, 308 aa, Corynebacterium glutamicum
MLRYVGRRLLQMIPVFFGATLLIYALVFLMPGDPVQALGGDRGLTEAAAEKIRQEYNLDKPFIVQYLLYIKGIFVLDFGTTFSGQPVIDVMARAFPVTIKLAIMALLFESILGIIFGVIAGIRRGGIFDSTVLVLSLIVIAVPTFVIGFVLQFLVGVKWGLLPVTVGSNTSITALIMPAVVLGAVSFAYVLRLTRQSVSENLRADYVRTARAKGMSGFNVMNRHVLRNSLIPVATFLGADLGALMGGAIVTEGIFGINGVGGTLYQAILKGEPTTVVSIVTVLVIVYIIANLLVDLIYAVLDPRIRYA

SEQ ID NO: 5683 - protein, 333 aa, Corynebacterium glutamicum
MGQDDQTPDQAHFFPQGRGEALVRPGQEHFIAATDETGLGAVDAVADDSAPTSMWGEAWRDLRRRPLFWVSAVLIILALLLAAVPQLFTSTDPQFCVLANSLDGPQSGHPFGFDRQGCDIFARTVYGARASVAVGVLTTLLVALIGTVFGALAGFFGGIMDTILSRITDMFFAIPLVLAAIVVMQMFKEHRTIVTVVLVLGLFGWTNIARITRGAVMTAKNEEYVTSARALGASKAKILLSHIMPNAAAPIIVYATVALGTFIVAEATLSFLGIGLPPSIVSWGADIAKAQTSLRTQPMVLFYPAMALALTVLSFIMMGDVVRDALDPKSRKR

SEQ ID NO: 5684 - protein, 577 aa, Corynebacterium glutamicum
MTTNIPQTPNHEGEQPLLELKDLKISFTSSTGVVDAVRGANLTIYPGQSVAIVGESGSGKSTTAMSIIGLLPGTGKVTEGSIMFDGQDITGLSNKQMEKYRGSEIGLVPQDPMTNLNPVWRIGTQVKESLRANHVVPGSEMDKRVAEVLAEAGLPDAERRAKQYPHEFSGGMRQRALIAIGLAARPKLLIADEPTSALDVTVQRQILDHLETLTKDLGTAVLFITHDLGLAAERAEHLVVMHRGRIVESGPSLKILRNPQHPYTQRLVKAAPSLASARIQSAQEQGIESAELLSATAVAEGTIPEMEEKVIEVKNLTREFDIRGARGDKKKLKAVDDVSFFVRKGTTTALVGESGSGKSTVANMVLNLLEPTSGEVLYNGTDLTSLSHKEIFQMRRKLQVVFQNPYGSLDPMYSIYRCIEEPLTIHKVGGDRKAREARVAELLDMVSMPRSTMRRYPNELSGGQRQRIAIARALALNPEVIVLDEAVSALDVLVQNQILTLLAELQQELKLTYLFITHDLAVVRQTADDVVVMQKGRIVEKGRTDDIFNDPQQHYTRDLINAVPGLGIELGTGENLV

SEQ ID NO: 5685 - protein, 588 aa, Corynebacterium glutamicum
MITRLSTLFLRTLREDPADAEVPSHKLLVRAGYIRRVAPGIYSWLPLGLRAVRNIEAVVREEMDAIGGQELLFPALLPREPYETTQRWTEYGDSLFRLKDRKGADYLLGPTHEEMFAATVKDLYNSYKDFPVTLYQIQTKYRDEERPRAGVLRGREFVMKDSYSFDISDAGLDESYAKHRAAYQRIFDRLGLEYAICQATSGAMGGSASEEFLAVSENGEDTFVRSTSGNYAANVEAVVTQPGVERDIEGLPEAVTYETPVSETIDALVDWANSIDVQIEGREVTAADTLKCIVVKVREPGAEEAELTGILLPGDREVDMKRLEASLEPAEVELAVESDFADNPFLVKGYVGPVGLAKNGVKVLADPRVVTGTSWITGADEKERHVVGLVAGRDFTPDGFIEAAEIKEGDPAPAGEGTLTLARGIEIGHIFQLGRKYTEAFDVQILDENGKRAIPTMGSYGLGVTRLLAVLAEQRHDDAGLNWSVEVAPYQVHVVAANKDAAAIEAAERFAAELSAAGLDVLFDDRPKVSPGVKFKDAELLGMPFALILGRGYAEGKVELRVRGGEKSELDADQAVAQIVEMVAQARN

SEQ ID NO: 5686 - protein, 245 aa, Corynebacterium glutamicum
MLIVLPPSETKTHGGSGKPLDFHHLSFPSLTKARQTILADLQALEVDEALKVLGISEKLRPEAESNRALETSPTMPAIFRYSGVLYDALDAATLPEKALERLAIGSALFGVIHATDPIPHYRLSGGTKLPTKSGELPTMKARWGTSISEALIDVNQLVIDLRSGTYQQLGRVKDAVTVRVESVMEDGSRKVVSHFNKHYKGELARVLALSEKEAHNAEDVMSIAQAAGLVVEENPNHKETLTLVV

SEQ ID NO: 5687 - protein, 253 aa, Corynebacterium glutamicum
MRLASMGEEDSTPGRRSKAYSRQGADVRPMKGGHGINLVGTLMAATERGANIVEGVVDFRPTDLRGSLRRGREANLIVFVVDTSGSMAARSRVRAVTGTITSMLNDAYQRRDKVAVIAVNGNKPTLVLNPTNSVEQAQQKLKDMPMGGRTPLAEGLLMAKDLMARELRKEPGRRAILMVMTDGQDTSDAGEAGIATAAETVVKSRLSGNVVIDCEGRLKVRKERAGVLAEMLGGVCVRLRDLNSEHIKMVINA

SEQ ID NO: 5688 - protein, 367 aa, Corynebacterium glutamicum
MASQQIRYPFSAVVGQDELRLALILTAISPRIGGVVIRGEKGTAKTTTVRAFAGLLGDAPLVNLPLGSTEDRVVGSLNMETVLTTGRAEYQPGLLAQADGGVLYVDEVNLLADHLVDALLDAAASGRVSIERDGISHSSPANFVLVGTMNPEEGELRPQLLDRFGLAVDVAASTNPEVRVEIIRRRLDFENAPEQFMAKWAEQDADTSNRILAAKDLLPGVELPDLILSQIAWLCARIEVDGMRADLVITRTALAHAAWAGRTVVTEEDVEIAARLALPHRRRRNPFDAPEMEERKLQETLQEARDFFKDNEDKGPAAKITDEETGAEAFTDTDNPTEEDGLQGTAQAKAQTTGKVGTAGSGDPFRS

SEQ ID NO: 5689 - protein, 250 aa, Corynebacterium glutamicum
MTISQENQPIIQPVSLIGGGPGAWDLITVRGMNRLQEADVILADHLGPTDELEKLCDISSKTVVDVSKLPYGRQVTQERTNEMLVEYAQQGLKVVRLKGGDPYVFGRGFEELEFLGEHGIECEVIPGVTSAVSVPAAAGIPITNRGVVHSFTVVSGHLPPGHPKSLVDWAALAKSGGTLSIIMGVKNAGAIAEALMDGGLDADTPAAVIQEGTTDAQRSVRCTLGTLGAVMVEEEIKPPAVYVIGQVAGL

SEQ ID NO: 5690 - protein, 474 aa, Corynebacterium glutamicum
MNTAPFKLEADFASALPTMAAPWQGEEAPNPELVILNDDLAYSLGLDPTWLRTPEGVQFLLGLNPEPLTKAVAQAYSGHQFGQFVASLGDGRALLLGEARSADGVLHDIHLKGSGRTQFSRGADGRAVLGPVLREYIISEAMHALGVPTTRSLAVISTGRKIQRGSVAPGAVLVRVATSLIRVGSFQYSNISGGIELSQHLANYTITRHFPSLVAELSAPTPATYVSLFKAILQRQADTVGKWTRLGFVHGALNTDNTLISGETVDYGPCAFMERYRGDAKFSSIDTYGRYKFENQPMILGWNMARLVETLLPLLGATPDEGMTAAQEALVEFDDLCEQAIRKEFATALGLDESDTGTVEQFRELLYLHNPDITTLLRALTDNTAPPSGFEAFVHDWKTQDPDIEAMRAVNPLFIPRNHLVEAALADAVEGNLEKFHELLAAVTNPFDPTAGPDELRLPSEEGFEEDYMTFCGT

SEQ ID NO: 5691 - protein, 300 aa, Corynebacterium glutamicum
MQKITPNIWCQGTADEAAEFYVNAFSEFPGGAEVLTTVKYPEAGLLDFQEPFAGKTLTVELAISGFKIILINAGEEFTPNPSISFMVNFDAVRDENAKEHLDAVWEKLHEGGSTLMPVDTYPFSEYYGWVQDKYGVSWQLMLSRPEEKPGPAVIPTLLFGGAAQNQAGPAQENYVEVFPNSQLGDRAPYGQQTGPATPEALMFSQFQLDGQWIFAMDSGVEQDFTFSEGVSLMYEAHGQEELDAIWNALSAVPEAEACGWLKDKFGVSWQIVPDNMEELMAKPGAYEKLLAMKKINIAEF

SEQ ID NO: 5692 - protein, 338 aa, Corynebacterium glutamicum
MQQWKPDFLGEGYQNLTIELGDDPDNETDVVTTVVRYNPDNHADESFAARPALLWVHGMTDYFFHTEFAEFFHNAGFAVYGIDLRKCGRSYRPGQQWHYTSDLAHYFPDLTAAAEVISSTHPELVPVAHSTGGLIVPLWMSQMRTSNPAAIEKIPALVLNSPWLDMMYPPLFIKLITPMVRVLGKRSPTTIIPGGGLGAYGKSIHKNFYGEWDFDTTIKPVEGHKKSIGWLRAVMAGQAEIHHDHVNVGVDVLTLCSNKSWLKSEYTEDTNTSDAVLDVKHIQKWAPHLSSPSSRVDVEIIDNARHDIFLSRKPARDHASEVLNNWLQSKLSSLKPSQ

SEQ ID NO: 5693 - protein, 465 aa, Corynebacterium glutamicum
MSEQPASIKHYDLIIIGTGSGNSIPGPEFDDKSIAIVEKGAFGGTCLNVGCIPTKMYVYAADIAQEIQESARLGIDATVNSVDWPSIVSRVFDKRIDLIAQGGEAYRRGPETPNIDVYDMHASFVDSKTISTGIAGQEQLISGTDIVIATGSRPYIPEAIAESGARYYTNEDIMRLAQQPESLVIVGGGFIALEFAHVFEALGTKVTILNRSDVLLREADADISAKILELSKKRFDVRLSTAVTAVHNKADGGVKISTDTGDDIEADILLVATGRTPNGNQMNLDAAGIEMNGRSIKVDEFGRTSVEGVWALGDVSSPYKLKHVANAEMRAIKHNLANPNDLQKMPHDFVPSAVFTNPQISQVGMTEQEAREAGLDITVKIQNYSDVAYGWAMEDKDGFVKLIADKDTGKLVGAHIIGAQASTLIQQLITVMAFGIDAREAATKQYWIHPALPEVIENALLGLEF

SEQ ID NO: 5694 - protein, 314 aa, Corynebacterium glutamicum
MWHLLQVIRVGKVVLDCSHFRIGYVLELVRGGDIAKRPHAFNTGATEFINLDGTTVHLDACGVQVHLVAVRGATSGNEQNICLDVVAGVGGDLHAAVGLVVYCGDRSAEADVETLFGKLEDFRGDVCICLAQQHVRAVEDGDLGAKRFKNVSKFQSDETATNNHQRFRLLCQAHDVFVGVVACAGLCNSFRDVRAGAGCDYNVSTADQLFLAGNTSGDCLGINKRCVHVIHIDVWSFGATSISLAALRDEVDALVENAADDGRPIHAVDRRIDTQASRLLNFLSDIRSVNVHLGRDAAHIEASSAESTLFHDGN

SEQ ID NO: 5695 - protein, 158 aa, Corynebacterium glutamicum
MNALLASSHLKKRRWFVVAGNLIIPPSPSTRGWKPDYFRRTILMRSFRTAAVAGLTAVALSVGSATVATAEESDQNLSSGFSALSSGGAAAVGEDWDADQPVTGEDIFGEEHERDNENTPAWAKNMYDLTVLGGIASLLGVIVFPAYNYLVYTGVIKG

SEQ ID NO: 5696 - protein, 119 aa, Corynebacterium glutamicum
MRKFRNTAIALVSAAAITLGGVTAATAQEDETPPAAETETTSPSGSSGSSWNDYNEEYEGDQEGYGIDGFGSSRDDSGEEVPRWLETWGKVFDALTITSVLGLVVFPVVNFLKYNGLIK

SEQ ID NO: 5697 - protein, 243 aa, Corynebacterium glutamicum
MSGFLTPPATPHIRTATASIATAVAVALSVFAAALIPGSALYSVLTAGGVALGAASGVAALRHRGGLRIFQWLSALGGIVILLIGIVVAVAKFGASAKLATLGLVTSYYLMPSAALACYIGGLGQLPAKWIAPAFMATAGAGAAGWFSLGAGTGFERFLIAVAAVFSLMGCVYPVWGCVVKRPRQVAAWLVALAALVLGALMLFMVSMVVAPGLLWLQPTTVAWGFMIAGVLATVAGLWPRRF

SEQ ID NO: 5698 - protein, 263 aa, Corynebacterium glutamicum
MWKDEVQEAIGEPFVQAPEVIEKMRETSRIAANSLKIAGEAVKPGVTTDELDRIVHEYTCDMGAYPSDLGYRGFTKSSCISLNEIVCHGIPDSTVIEEGDIVNIDVTAFKHGVHGDCNATFLAGDVSEEHRLLVERTEEAMMRSIRAAKPGREINVIGRVIESYAKRFGYNVVRDFTGHGIGPTFHNGLVVLHYDNTQYRDLLVPGMTLTIEPMINLGSLDYEIWEDDWTVQNVDRKFSAQFEHTIVITEDGNEILTLPDDSV

SEQ ID NO: 5699 - protein, 622 aa, Corynebacterium glutamicum
MNKVQRRSLMALCMTVAFAGGSLTACTPRPDTADPIAEEFLQAWASQDFDTIADITDQADLATEMLSTSFDGLQADSVELTLDSVDSRDTIATANFSVVWKLPRDREVSYDSSMTLTKMRNEWTVRWEPSLVHPKLGANQHLELRAIEAQRANVISSDGAPVLAPGSIYRVLVDPSAGDADVVVKRVADYLNEAHATDENVNTLDVEDIMSNLGDSTYSLTTVDANLGARMEQDLAGIPGLTFNEEASMVATDPGFAPDIVSRVARIVEDELEGSNGWRASIVTSNGAVIDDIAYDAPELAPSVRISLDHNVQRAAEEAVDLRAEMKAMMVVMRPSTGEILAVAQTDEADKDGDVALMGQYPPGSTFKIITAAAGLAHEGLTPDSIVPCPGTMNIYGRIVTNYNSFSLGNTSLDDAFANSCNTTFADISTNLEPGQLKNVAKQFGLGIDYQIPGLDTMTGSVPEGDIVLDRTESGYGQGLDLASPFGMALVASTAATGSVPTPTLISGHETVASEEVLALDPEVLANVQRMMKSVVNDGTARGMRQTGGQIYAKTGEAEINEGSHAWFTGYREDDIAFATLVVLGGGSEAAAAVTDQFFVKLDELRAGGEVAVSEAEEQPVG

SEQ ID NO: 5700 - protein, 210 aa, Corynebacterium glutamicum
MIRILLADDHPVVRAGLASLLVSEDDFEIVDMVGTPDDAVARAAEGGVDVVLMDLRFGDQPGIEVAGGVEATRRIRALDNPPQVLVVTNYSTDGDVVGAVSAGAVGYLLKDSSPEDLIAGVRDAARGESVLSKQVASKIMGRMNNPMTALSAREIEVLSLVAQGQSNREIGKKLFLTEATVKSHMGHVFNKLDVTSRTAAVAEARQRGII

SEQ ID NO: 5701 - protein, 383 aa, Corynebacterium glutamicum
MIYRGGVKTSQATIARIERVLIWGLHLLIAVLLVLVCWRASHWGVWVLAFGYGVVYVAGVVPNSPFKNHPMAWFLVLSLLWASLIWDGPEPAYLVFPMFFLAVLITTPLKSAIIIAILTAIAVVTLAMHLGFSVGVVTGPILGALVAWVMGTCFQLLAQALKELVDARASAIRASKSAGEQAERARIAGEIHDTVAQGLSSIQMLLHAAEKRVDDPQALSHIRLARQTTADNLAETRQIIAALQPTPLIGADLPVALARLSSTTPMGQNITFEVDGSPRVLPDAMEAEIVRIAQTLLGNVVRHAQADSAKMTLTYQDDQILLDVIDNGQGFDVAEVIRKKSIGLPTAQRRAEGLGGTIIIESTIGSGTGISARFPYPQKDQDK

SEQ ID NO: 5702 - protein, 319 aa, Corynebacterium glutamicum
MFQGLKELTAAKGRTLLITVTVGLIAVLVTFLSALTAGLGHQSVSALKYLAGDNELILADSGSTTLSASTLSDQAVAQLEDEGAQMLWQVRDRVADTPTMLLNSPDLAPGEVSLPAELADSELATAHDVVDSSNDLYLDHLPVVLMNTSDLASLAQVRGVTGPAGAFASDVALPSDTVALSGSERWNASASYQGEQMSLNLMIVMLYVISALVLGAFFTVWTIQRLRGIAISSALGAARRVLIADALGQAIIVLGIGITAGTLITVISAFGMGDAMPVVISSSTTLFPALILAAAGLIGAAISLGPILRVEPRSALMNA

SEQ ID NO: 5703 - protein, 230 aa, Corynebacterium glutamicum
MTLHVSNLNLTVADGSTSRTLLNNITFDVQPGEVVGITGPSGSGKSTLLAVLGCLQSADSGTATLGDIDLLNPQNRAALRRNHLGIVFQQPNLLPSLTVLDQLLLIPRLGRILPPSRSARTQHKDKALSLLNSIGLGDLAKRKVSELSGGQQARVNLARALMNSPKLLLVDEPTAALDQHSASEVTELIVSMAHQYNAPTLFVSHDMDAVNTLDRSIELVDGHLLTPHTL

SEQ ID NO: 5704 - protein, 54 aa, Corynebacterium glutamicum
MTKKSSRGNSWSPGLVLAEQYRPIWPKIDRRKFFGHLVWSVAGLQKNCTGAWKK

SEQ ID NO: 5705 - protein, 378 aa, Corynebacterium glutamicum
MLAPRRKTRQLMVGKVGVGSDHPISVQSMTTTKTHDINGTLQQIAQLTATGCDIVRVACPKTVDAEALPIIAKKSPIPVIADIHFQPKYIFAAIDAGCAAVRVNPGNIKEFDGRVKEVAKAAGDAGIPIRIGVNGGSLDKRILDKYHGKATPEALVESAMWEAGLFEEHGFGDIAISVKHSDPVLMVEAYRQLAEQSDYPLHLGVTEAGPKFMGTIKSSVAFGALLSQGIGDTIRVSLSADPVEEIKVGDQILQSLNLRPRKLEIVSCPSCGRAQVDVYSLAEEVTEALDGMEVPLRVAVMGCVVNGPGEARDADLGVASGNGKGQIFVKGEVIKTVPESQIVETLIEEAMRIAEEMDPEVLAAASASGMKAEVKVTK

SEQ ID NO: 5706 - protein, 204 aa, Corynebacterium glutamicum
MCPPSSGGSGTRLNSARKKFRLASIIMNMSHMERSTNSPPMRDAPTTLMGLSTSRSAPKMDATTPGIFAGKALRPSHVALIMSPVKRAVAPTPSIGPYFLYTSVGGRLDMPTAPTVISEPSEARRVTEATWRSTSKSVPSRSIVSVAVSPGSSRIASRMAVKLAISWPLTAKILSPCSMPASPAGPEPTQEDSSVAEIWVSGTH

SEQ ID NO: 5707 - protein, 404 aa, Corynebacterium glutamicum
MAAYLLGVVLFFLGIAVTIALHEWGHFITARIFGMKVRRFFIGFGPTVFAKRRGETVYGLKAIPVGGFCDIAGMTAQDELDPEDLPRAMYLKPWWQRIIVLSGGVIMNLIVGFLVLYGVAVSSGIPNPDVDTTATVDTVQCVPETQISATELSSCVGSGPAGDAGIEHGDKILAVNGQEMASFTAIRDAILELPGETATLTIEREGTLFDVDLQVASVTRLASDGSEITVGAVGMSSLPPTDVYKKYGPIEGVGATARFTGDMISATWDGLKAFPAKIPGVVASIFGAERDVESPMSVVGASRIGGEFVERSMWDMFMMMLASLNFFLALFNLVPLPPLDGGHIAVVIYEKIRDFFRKLRGKPAGGPADYTKLMPVTVAVAALLMTVGGLVIVADVVNPIRLFG

SEQ ID NO: 5708 - protein, 215 aa, Corynebacterium glutamicum
MVAPSVNVIMEWMIDCGCTVTSMRSASVSNSRVASMSSRPLLIRVAEFNVFICPIAHVGCAAACSGVTSHIFSLVQPLKGPPEAVSTIRATSSRVPERKHCAMAECSESTGMICPSFAFEVTNSPPATSDSLLAKARCAPDSRVASVAASPKEPTRALSTVSAFVVSTRIFAASVPEMISPPRAFEITAAACASATATLSAASPNCCACEITRSG

SEQ ID NO: 5709 - protein, 392 aa, Corynebacterium glutamicum
MGVVTKKILILGSTGSIGTQALDVIADNSDKFEVVGIAAGGSQPDLVISQAQQLGLAADKVAVADAQAAAVISKALGGEIISGTDAAKILVETTKADTVLNALVGSLGLAATLATLESGAHLALANKESLVAGGEFVTSKAKLGQIIPVDSEHSAMAQCLRSGTRDEVARIVLTASGGPFRGWTREKMWEVTPEQAAAHPTWAMGQMNTLNSATLINKGLELIEATLLFETDADLIDVTVHPQSIIHSMITFTDGATIAQASPPSMKLPIALALDWPHRVPKAQPALDFTAAHTWAFEPVDDAAFPAVQLARHVAKQKGTYPAVYNAANEEAAEAFLRGRIKFPQIVDVVDEVLQGASQFAGVASHVDDILATESEARARANALINRLATNL

SEQ ID NO: 5710 - protein, 147 aa, Corynebacterium glutamicum
MAGSSHTIEPEIYRGVSTLDEPSAAWGWHGLKRNTIQLAGWISVLFMLGYNFGNHKGHVETIWLLVITALLVIGLLIHLFEPKLSQVRTITSRNKPVGHVEPDWTYDQATLTGTWGNLTDSQLRSVNIEPSRVAHLRAADSAKELDN

SEQ ID NO: 5711 - protein, 160 aa, Corynebacterium glutamicum
MSDTAWLDVDGAKLGVSEVTPGAGEGCLVVGPVWLDVADRLVAGSDGANLGELWLEQVDQQADDQKGGDDEKPDGFNVALVVTEVVSKHEQNGNPASELDGVALETVPSPCSRRLIKGGYTAVDLRLNRVGGTSHVLLLYSQVAVVRLRARCNKHLQNLV

SEQ ID NO: 5712 - protein, 526 aa, Corynebacterium glutamicum
MTKTLLKLQLTLWGRTIKGNKAAIVMMSLISFYALMGLFGFGIFLALGLGQDHMGILAGVVSVGMVAYCIAAFMWPSGEGQLDPTAFSTMPLSAKQLLPGFAIGTLLQSRGIIAVICTVATSIIAAVFLPVGSWPMIVFMMAVSLVTTLLLGELLGALTSGSSSRVSNDRRTVLTSVVFMVFVVGYNMLIGADGMSRIDAIGAYTKWTPFGAGAGAIEAFAVGLWGEAGLLTLLAFVYVAAGFWLWSQLINRALTAPLDQGGQGQSAKDSAGEGKKVLFLPGIPWSVGGAIFSRSLRYMFRDSRLLGSMIVFPLLGVLFIFQSFTVEFFMIYVGLIMMAVFAGSVATNDFGYDGPSLWLNIVAGVKARTLLMPRHWASMLPGSVSIVVFMIITIVLAENKTTAVLICFIGLGIFISSAAVALLVTTFNPYPTSKPGTSPWGDRSGYSGAAFVGAFAALLLGWIPTIPTIALGIFGLVTDQMWMIILAEVLAIILPVAVYIGVAKVCIRKVEKDLPEIFDKVKTHVK

SEQ ID NO: 5713 - protein, 285 aa, Corynebacterium glutamicum
MTDPENSQGTPQICPTDPTTQALAVRGLTKSYGDATVVNNINLDIPKGAIYGIVGPNGAGKTTMLSMATGLLRPNKGTAWISGFNVWEEPNDAKRSMGLLADGLPIFDRLTGKELLTYVGALRELDEGIVDQRSEELLEALGLKEAAGKRVVDYSAGMTKKILLAQALIHNPKVLILDEPLEAVDPVSGRLIQQILKNFAQTGGTVVLSSHVMELVEGLCDHVAIINRGVVEIAGHVDEVRRGRSLTDVFVDAVGGAALQEGSLSWLGASEGHSEGQNQNEDRAE

SEQ ID NO: 5714 - protein, 366 aa, Corynebacterium glutamicum
MATPVPLVFNAPKRGMPPTHFADLNDEARIEALKELGLPKFRLNQIARHYYGRLEADPLTMTDLPEGARQEVKDALFPTLMSPLRVVETDDDTTQKTLWKLHDGTLLESVLMRYSDRSTLCISSQAGCGMACPFCATGQGGLDRNLSIGEIVDQVRNAAATMQSEGGRLSNIVFMGMGEPLANYKRVVSAVRQITQPSPAGFGISQRSVTVSTVGLAPAIRKLADEEMSVTLAVSLHTPDDELRDTLVPVNNRWPVAEVLDAARYYADKSGRRVSIEYALIRDVNDQDWRADMLGEKLHKALGSRVHVNLIPLNPTPGSKWDAAPKARQDEFVRRVIAKGVPCTVRDTKGQEIAAACGQLAAEESA

SEQ ID NO: 5715 - protein, 86 aa, Corynebacterium glutamicum
MAPKQTLAGGTWVALIVGALLLILLLVFIMQNQTTVELNLFAWTFQFPAGIGFLLAAITGALIMALVGGVRMFEYRRQLRKIRKAL

SEQ ID NO: 5716 - protein, 285 aa, Corynebacterium glutamicum
MPKPKNNAGRDLKAAIAVGIGLGVLVLLGIVLSPWGWYILVAGFMAAATWEVGSRLKEGGYHLPLPIMIIGGQAIIWLSWPFGTMGILASFVATVLVLMYFRIFYNGTEKEARNYLRDTSVGIFVLTWIPLFGSFAAMLSLMQNNSIPGTYFILTFMLCVIASDVGGYIAGVFFGSHPMAPLVSPKKSWEGFAGSIVLGSVTGALSVHFLLDHHWWMGVILGCALVVCATLGDLVESQFKRDLGIKDMSNLLPGHGGLMDRLDGMLPAAMVTWLILSVISSSYPS

SEQ ID NO: 5717 - protein, 185 aa, Corynebacterium glutamicum
MIDEILFEAEERMTATVEHTREDLTTIRTGRANPAMFNGVMAEYYGVPTPITQMSGITVPEPRMLLIKPYEMSSMQVIENAIRNSDLGVNPTNDGQVLRVTIPQLTEERRKDMVKLAKGKGEDGKIAIRNIRRKGMDQLKKLQKDGDAGEDEVQAAEKELDKVTAGFVAQVDEVVARKEKELMEV

SEQ ID NO: 5718 - protein, 243 aa, Corynebacterium glutamicum
MTTSSEQPRTGYKRVMLKLGGEMFGGGKVGVDPDVVDNVARQIAEVAKTGAEIAVVIGGGNFFRGAELQQRGMDRARSDYMGMLGTVMNCLALQDFLGQHGVECRVQTAINMAQVAEPYLPLRAERHLEKGRVVIFGAGMGMPYFSTDTTAAQRALEIGCDVLLMAKAVDGVYSDDPRTNPDAELFTEITPKEVIEKGLKVADATAFSLCMDNKMPILVFNLLTEGNIARAISGERIGTLVES

SEQ ID NO: 5719 - protein, 287 aa, Corynebacterium glutamicum
MALSLADLEASEGGDGNASLVQKSLNGLLAVSYRGLLKKYVLLVEAIQTTLNDLRDSLLWLALFASDLLSDGALLLDDLCRNVLTGEVRSLQSSNLHCSLTCSCLSCFTFTGESNQNANCWWQVSGTLVEVNSGLVALEGYCATKLKLLADLCGELLQSCVCGLSVHVNCCELFLGVSLCSCCCVCNLCSEFLEVRVLCNEVGLRVDLDHGVARNCNETFGSVTLCTLSDVLCALDAQDLNSLVEVASGLLQSLLAIEHAGTGEFAELLNIRSGVVRHYGAILLMYG

SEQ ID NO: 5720 - protein, 275 aa, Corynebacterium glutamicum
MANYTAADVKKLRELTGSGMLDCKKALEESAGDFDKAVEILRVKGAKDVGKRAERNATEGLVAVSGNTMVEVNSETDFVAKNSDFKEFAAKVADAAAAAKANSQEELAAVDVDGQTADAALQEFSAKIGEKLELRRAVTLEGDKTAVYLHQRSADLPPAVGVLVAFTGEGEAAEAAARQAAMQIAALKASYLTREDVPAEIIEKERSIAEQITREEGKPEQAIPKIVEGRLNGFYKENVLLEQSSVADSKKTVKALLDEAGVTVTSFARFEVGQA

SEQ ID NO: 5721 - protein, 272 aa, Corynebacterium glutamicum
MAVVTMRELLDAGVHFGHQTRRWNPKMRRFIFTERNGIYIIDLQQTLTYIDQAFEFVKETVAHGGTVLFVGTKKQAQEAVQVEADRVGMPYVNHRWLGGMLTNFQTVSKRLNRMKELQAMDAAENGYEGRTKREVLMLTRERTKLERVLGGIAEMTRVPSALWIIDTNKEHIAVAEAHKLNIPVVAILDTNCDPDVVDFPVPGNDDAIRSTALLSRVISTAVEEGKKAREERQLAAAKDAAGDAKPEAEEAPAAAEAEEAPAAEAEEAPAAE

SEQ ID NO: 5722 - protein, 168 aa, Corynebacterium glutamicum
MSPAMLNFMPFRLMWILALTFTLTLLTSPALAHPYVNPATGSDRAGPILRGFDKPEKNWLPGHRGVDLPLNIGETVLASGSGTVAFAGIVVGTPTISIDHADGVRTTYQPVHAHVSVGEHVEEGDAIGILGHPTTKFPGLQWGAKIGEEYINPLSLLPRPTIRLKPLN

SEQ ID NO: 5723 - protein, 308 aa, Corynebacterium glutamicum
MARSGRNAPPSGISGADAPSKLHTLIDDFCEHLDLVVGRSAATIRGYRSDLYAMADTIEDIDNFSLPTLRQWLGIAVDEGKSRATLARRTASVKAFSSWAQKNGHLKADEAARLISPKITRDLPKILGEQQAGDFVENAASTNEEEFLRDSAILELLYATGMRVAELCGIDLSDIDYDRKMVRVLGKGNKERVVPFGESAHKALRNWLDVRDEMTEDPKALFVGVRGQRINARQVRRIVDRAAKVTGVDHLSPHSLRHTAATHLLDGGADLRQVQELLGHSSMQTTQIYTHVSNKRLLEAFNKAHPRA

SEQ ID NO: 5724 - protein, 394 aa, Corynebacterium glutamicum
MIDSRLLAWAYLSKVVEGPNAHLQKLLKEGHDVERIAFGIKHREEWIGEGLLKNTDSRYSIDTAQTDLETIAKLGGRLITPEDDEWPMEELDHAFGFAASGMSDHVRTYQDDALPPHALWIRGGNLRTLSAQSVTLVGTRAISQYGTEVTREFTQNLVSHQWTIISGGALGVDSVAHSEAVRAQGSTIAIAACGLDRSYPSHNRDLFNQIAKSGKGALVSEYPPGTPPQRHRFLTRNRLVAALSQGTVVVEAAWRSGALNTLSWCAGLGRIAMAVPGPVNTAGSLGCHERIRNGSAQMVTSADDVRSLLGAVGAMDSQTQYELNFAATPVQGLTRNELRVFDALDDRGEGREAASIATEAGLTLQLTIFLLIALNKRGIVKRDGTAWSRNAEMP

SEQ ID NO: 5725 - protein, 507 aa, Corynebacterium glutamicum
MALGRTISTAQLGVQAKIVRVEANVGPGLPGTYIVGLADTAISESRDRIKTAVQNSGLMWPKTKVIINLSPASMRKQGSQCDLAMTVAVLVAHGSNPKAKFHAQNTLFLGEVALDGTLLPVTGVLPALLAAKEEGIGKIVIPEGNAQEAGLVEDPSVFLAHSIDQVLRWLDGEEALPQPGLFNDENSLKLPDMRDVVGQPEARFAAEVAAAGGHHMLMIGPPGSGKSMIAERIPSLLPELSPQQMIEATAVHSVVGRTFSGPVSRAPFISPHHNVSKAALLGGGSGSPLPGAISLAHHGVLFLDEVSEIPASILDSLRTPLEYGSIRIIRSRHDVTFPAQFQLILAANPCRCGAEQPQECVCSGSARATYLNNLSGPLRDRLDMVVATHSKGAVLRSDDVEASAPIADRVAQARERAAFRWRRSGLGNLVNAHVDPHFLRRNFAATEDAMVYLGAFLAEGTISQRGCDRAIKLGWTLCDLDGEQQPNLDHIARAMELRGTTYSEVAA

SEQ ID NO: 5726 - protein, 122 aa, Corynebacterium glutamicum
MKTQKQYLGAFGEDVALQQYLDDQATLLDRNVRYSCGELDLIVRSASGVVVFVEVKTRRGSAFDSAAAVNNQKMLRMRRAAALWLEGKPYTPIRFDVVAIVLDPHTGRPEITVYEDVEHGAR

SEQ ID NO: 5727 - protein, 101 aa, Corynebacterium glutamicum
MSAEELDNYEAEVELSLYREYRDVVSQFSYVVETERRFYLANAVQLIPHNSGNDVYYEVRMSDAWVWDMYRSARFVRYVRVITYKDVNIEELDKPDIIMPE

SEQ ID NO: 5728 - protein, 209 aa, Corynebacterium glutamicum
MSRNGLGPVAGVDEAGRGACCGPISIAACILPDKPIQELAALTDSKKLSASTREKLMPLIKKHALAWSVIVISAQDIDRFGIQHANISGMRRAVAALGTQPGYVLTDAMKVPGFTVPYLPIIGGDASARCIAAASVLAKQTRDDIMTDMANDYPHYGLEIHKGYSTKIHMDAVRHHGASPEHRYSYANVAKAHQEWLHAADNDTTEGGA

SEQ ID NO: 5729 - protein, 264 aa, Corynebacterium glutamicum
MRGASKSELLAFDGRVVDATDSAKWQDNCLNFALDVFLRDGSLVLIAQVVAGIHGVGAVVTHHEVVAARHGDGAEIVAAAFGGTGGLIDGELRRLQRVAVIDFLAVNHDSRITGLARNSLTAGGDNALDQVIFIRCDKTHVRTQVLQAADHRIIGTLRSESNVPGISTLEHHNIARLWIREVVRNLLHQDAVTRAALTSVQSRFHRTTRNHVHASDKRLEHENQREGQNHNHWNFDVPRSWLRFLLRLSSTSTRTTVLRGIVSI

SEQ ID NO: 5730 - protein, 262 aa, Corynebacterium glutamicum
MTDFSSASNADDSTQDGRPGRRAGKSKKESKPTPWYIEIPVVVVLTLALIFVLQTFVGRMYMIPSGSMEPTLHGCEGCTGDRILVEKVSYYFTDPEPGDVVVFKGTDSWNVGFTTQRSDNSVIRGLQNLGSYVGLVAPDENDLVKRIIATGGQTVSCQAGDPGIMVDGKEVDDSYTLQPAQFPIDETSGSTECGGNYFGPITVPGGNYFMMGDNRTNSMDSRYHLGDQYQGTIPEENIKGKVQAIILPFSRIGGVDDPAIKG

SEQ ID NO: 5731 - protein, 312 aa, Corynebacterium glutamicum
MKISRRAFLGTLLGATTLAVTACAQSSQNQNSSASSSSSSSAESSTSSSSSDEQRIVALNTGQLDNLLLLGITPVGVAAAKNSDLIPQFLKDRFGADMDLDSIADCGLRQSPDIEAIANLNPTLICANSRADEEVLNKLRTIAPVVTGEGGGENWKQDLLTIAEAAGQKEKAETLLKSYEDSAAEIAANQPANPPTVSFLRTKDQEFQMYGAQSMAGTVAADCGYARPENQQFTDTAGQDLSAELIAQADADWLFYGIKEGNINPEDTPLWTSLKAVQSNQAIPVDGDSWYLNASLVSAEIILQGLKDNVTV

SEQ ID NO: 5732 - protein, 71 aa, Corynebacterium glutamicum
MIGWGFLCFLGWVLWGFVGFIPHLSRVHPAGNSDKTWVGSFRGDQKEKPNRGAKTSVIWGIWARLFGLRLR

SEQ ID NO: 5733 - protein, 113 aa, Corynebacterium glutamicum
MNILDKIDAASLRDDVPAFRAGDTLDVHVKVIEGTTTRTQLFKGVVIRRQGGGIRETFTVRKVSFGIGVERTFPVHSPNIEKIEVIRRGDVRRAKLYYLRELRGKAARIKEKR

SEQ ID NO: 5734 - protein, 221 aa, Corynebacterium glutamicum
MFENRFDLRCYVVTGAGSVDEVVHTASAAARGGAGVVQVRSKPISPEAMRELASKVALEVARCSPTTRVLIDDHLHVASSLMREGLPIHGVHLGQDDMSVLEARELLGPEAIIGLTTGTLELVAAANELSDVLDYIGAGPFRKTPTKDSGRPPIGLAGYPPLVELSKVPIVAIGDVTPADVRALSATGVAGVAMVRAFSESDDPQQVAENVVANFELGRLS

SEQ ID NO: 5735 - protein, 360 aa, Corynebacterium glutamicum
MTTCFEFQEAGYQVTLIDPDPISGATHHAGGMLAPTAEVQYQQHDLILLMKESARLYPDLLQRVSKYTDLPTGYRTDGTLLIGADRADGMHVAELIKYMHLKDLPVDVLTTRQARAAEPALSPRISKVVSIDGDHQLSPRLYARALLDAILQRGAEHIADAVISIDGHDPCLTVTMNSGVRVASKSVVVLAAGLGAASIPGWFEGANPLQLRPVYGDIVRVRVPERLQPMVTKVVRGFVEDRQIYIIPRTDGTLAIGATSREDHPQPRTGAVHDLLRDAIRLIPGIEETEFIEVTCGARPGTPDDLPYLGWVGSNVIASTGYFRHGILLSALGARAAVDMATNQPLFPTLDVCDPFRHQI

SEQ ID NO: 5736 - protein, 65 aa, Corynebacterium glutamicum
MITYTFNGTSMRSSELTVEQLVHQEIGHDTGVAVAINAAVVPRSQWSRAICDNDSVEVLTAIQGG

SEQ ID NO: 5737 - protein, 260 aa, Corynebacterium glutamicum
MLHIADKTFDSHLIMGTGGATSQALLEESLVASGTQLTTVAMRRHQATTSSGESIFAMLRRLEIALLPNTAGCRTARDAVLTAQLAREALDTNWVKVEVIADEHTLLPDTVELLDACELLVHDGFTVLAYTSDDPITASRLEDCGVAAVMPLGSPIGTGLGILNPHNIELICSRASVPVILDAGVGTASDATLAMELGCDGVLLASAINRAQNPVAMAESMFHAVEAGRLAAQAGRIPQRQHAVASSSFEGLASWAEQVL

SEQ ID NO: 5738 - protein, 378 aa, Corynebacterium glutamicum
MRWPHQVLKVWHPGRSRCFNMAQLPTSELHRTARQLALPGYGIEQQERLFNAHVLVIGAGGLGCPVMQSLASAGVGTITVIDDDTVDISNIHRQILFGASDVGRPKVEVAAERLKELQPDITVNALHERITPENACELLNSVDLVLDGSDSFSTKYLVSDAAEITGTPLIWATVLRFHGELALFNSGPDHRGVGLRDVFPEQPSADFVPDCATAGVLGATTATIGALMATHAIGFLTEIGDVQPGTILSYDAFPAATRSFRVSADPARPLVTRLRASYEAARTDTTSLIDATLNGSLTALDIREPHEVLLKDLPEGATSLKLPLSQITSDSDILEALSGIDGDILVYCASGIRSSDFIDNYSHLGHKFVNLPGGVNAL

SEQ ID NO: 5739 - protein, 758 aa, Corynebacterium glutamicum
MSSISRTIALELGVKDEQVEAAIKLLDEGNTVPFIARYRKEITGGLDDTQLRDLEERLSYLRELEDRKQSILAAIEEQGKLTDDLRSLILGCDTKARLEDLYLPFKKRRKTKADIAREAGLEGLVDKLIDAPSLDAAAQAAAFTTEGFEDSKKVLDGARAILIDRFALDADLVGEVREQMYRAGSMAASVVAGKEQEGAKFKDYFEFSEPFDKLPSHRILALLRGENEGVLSLNLDAGDDIIYEGLIADRFSLDTHTSSWLAEAVRWGWRTKLYVSSGLDVRMRLKEKAEEGALDVFATNLRDVLLAAPAGQRSTIGLDPGFRNGVKVAVVDSTGKDVATTIVYPHQPQNRWKEAVSELANLCATHGVELMAIGNGTASRETEKLAGEVADMIKAAGGTRPTPVVVSESGASVYSASPIAAEEFPDMDVSLRGAVSIARRLQDPLAELVKIEPKAIGVGQYQHDVNQVALAKTLDGVVEDAVNAVGVNLNTASAPLLTRVAGVTSTLANNIVAYRNENGGFSSRKELNKVPRLGPKAFEQCAGFLRISGSTDPLDASAVHPEAYPVVRNIAKATGLDVSGLIGNSAVLTKLKPADFADERFGIPTVTDIIAELDKPGRDPRPEFKTASFKEGVEKISDLTPGMILEGTVTNVAAFGAFVDVGVHQDGLVHVSAMSDKFISNPHEVVRSGEVVKVKVMEVDVDRKRIGLSLRLTDEPGAPAPQKRGNRPAKQQRAPQKQSAKPATGSMADALRRAGLGG

SEQ ID NO: 5740 - protein, 325 aa, Corynebacterium glutamicum
MSAKSSLKEVAELAGVGYATASRALSGKGYVSPQTREKVQAAAKELNYVPNQLAKALREHRSALVGVIVPDLSNEYYSESLQTIQQDLKAAGYQMLVAEANSVQAQDVVMESLISIQAAGIIHVPVVGSIAPEGIPMVQLTRGELGPGFPRVLCDDEAGFFQLTESVLGGSGMNIAALVGEESLSTTQERMRGISHAASIYGAEVTFHFGHYSVESGEEMAQVVFNNGLPDALIVASPRLMAGVMRAFTRLNVRVPHDVVIGGYDDPEWYSFVGAGITTFVPPHEEMGKEAVRLLVDLIENPELPTGDVVLQGQVILRGSSTHSG

SEQ ID NO: 5741 - protein, 476 aa, Corynebacterium glutamicum
MEQSFNQVGNSSVDCGCHVVCPHPEALTDQAWRMFGLFIATIVAIILKPMPMGAVTIIGMIAAVLTGLVPLTASSDDPGAVYGLIGFSNGTIWLIVMAFLISRGFIKTGLGRRIALFFVSKVGGKMLGVTYGLALADLVLAPAIPSATARGGGIMAPIMKSVALTYDSTPGPTRRRAGAFLALNVGQVNAITCAMFLTAMAGNPLIASLASQMDVNITWTNWAVGAIVPGLVALIVVPWVVYKIYPPELKDTPEVKKMASDELKQLGGFTYGEKVLAGTFVVLLLLWTGGDLVLGISATTTAFVGVIILLVAHVLTWEDIIQEKTAWDTMVWFAVLYMMATALSQYGFIAWISEVIASSLGGMNWVVALVVLVLIYFFSHYFFASATAHISAMYLAFLGAAIAIGAPPLMAALVLAYTSNLFSSLTQYSGGPSPTLFGLNYITVGEWWRTSAIAGAVSITIWLVIGGLWMNVIGLW

SEQ ID NO: 5742 - protein, 73 aa, Corynebacterium glutamicum
MSTPIKNQSQGVNAPARSHWSNLLIKLGIPALIVVAMWFARTLKHSRIKRGGCLACSSRRLWRLFSSQCQWVP

SEQ ID NO: 5743 - protein, 417 aa, Corynebacterium glutamicum
MAAERALSTAQARHGVITEDDAAQINQAAVLSNIDREKLWEDAKNVGYPILGLVRQIASHLPEGPNGRVHYGATTQVIMDTGLVLQMTASLNALDKQIVRLGNALAARAEEHKDTVMPGRTHAQQAIPTTFGATLATFLDQIRRQRERLEEALERVRVISLFGAGGNNAAQGEQAATVRAEMARLLDLKDPVVSWHVERDVLGDFGWVCSTLCGSMAKFGRNIVDLSRTEIGEVFEPYNSHRGASSMMPQKVNPISSELMIGISVVAGALTSTLPRLQESGHERAAGEWQGEWLVIPTLANLAGAALDEAIVVAEGMRVDTDRMSSNLAFAGGLIMAEAQMIQLAPALGREKAHDLVYEASTKTREEHTTLAEELPIIAVQHGVEDLLPKNFAQPADYVGEAQSMVNAAVAAWNAQL

SEQ ID NO: 5744 - protein, 33 aa, Corynebacterium glutamicum
MESYPQRYDDRYSWSRKVGKLTPAPRGVLSAQI

SEQ ID NO: 5745 - protein, 131 aa, Corynebacterium glutamicum
MVERNMTTMREVSTDLNILIVPSEWEKVLENLPATLSESGFVASEIHSQIVDLTCEPDNMLVTQFSQLEGHPPIVEVLHRLVINGSSDLELKDLTKKVVGALPQGTYWYGTSLEGATEPGVNASCAWQHRG

SEQ ID NO: 5746 - protein, 230 aa, Corynebacterium glutamicum
MTETTPQPPKPEPELPKFLSNPERADIILFIALIVMGIFSLCMIPLRAWMLTQPLAYTLIVGGYTSAVVGGANASVENGIWWVYWLCTLIGALKFMPVYWLMGKRWGMEFIDMSLQYMPRFHRMFKKSVDSESTRLYAWIIGLIPLAYLPGPVPGTILNAVAGLVKIRFWIIMAWNAICVLSVNGLFIWLGYTFGEQVLDIVNVVNRYMLWITLGLLALMFFRARKQFAK

SEQ ID NO: 5747 - protein, 273 aa, Corynebacterium glutamicum
MTIFPEYLDPLRHALLGKAIEDGILEVGVHDLRNWATGGHKAVDDTPYGGGPGMVMKPEVWGPALDDVAAGRVSGAELDSASLHLKNVRHDELGGVEKRAYVVEEDRDLPLLLVPTPAGKPFTQADAQAWSNEEHIVFACGRYEGIDQRVIDDAANRYRVREVSIGDYVLIGGEVAVLVIAEAVVRLIPGVLGNRRSHEEDSFSDGLLEGPSYTKPRTWRGLDVPEVLFSGNHAKVDRWRRDQALLRTQAIRPELIDASLLDSTDLKVLGLDK

SEQ ID NO: 5748 - protein, 216 aa, Corynebacterium glutamicum
MKPHTLLRQALAIGSVGGLLVLSACGNSDSTSPTVSETVTEIVTETSAPDSTAAPIESSPATSSDAVPSEVVPSEGVPKQCTTSELNISTGTQQGAAGSVLIDLNFTNAGSTDCTLHGFPGVSFVGMDNGTQIGAPAVREGDAFPAVTLGPGENTIAALKISRAENYDSDACSLQPVDGLRVYPPGETASEYLPLEGFNGCDNDGLKLLTIKSVGA

SEQ ID NO: 5749 - protein, 171 aa, Corynebacterium glutamicum
MSTEQELQIGKVVKSHGIRGEVVVELSTDDPDIRFAIGEVLNGKQAGKEHSLTIDAARMHQGRLLVKFAEVPDRTAADSLRGTRFFAAPLEDEDDEDGFYDHELEGLRVIHEGEDIGEVTGVMHGPAGEILEVRLTSGKETLIPFVHAIVPEVDLEEGTATITPPEGLLDL

SEQ ID NO: 5750 - protein, 116 aa, Corynebacterium glutamicum
MTVFNVLHDAPAPQPDKNRPGVKRLLQGDGANLIAFTFSPGQSLPDHRAAHPITVTAFSGQLTFSYGEETFELSPGVTVHLEAGVTHRVDCPPEAPGDAVMLLTMLTGEKHSVNQA

SEQ ID NO: 5751 - protein, 165 aa, Corynebacterium glutamicum
MAVKIKLQRLGKIRTPHYRVVIADARTKRDGKVIENIGIYEPKAEPSVIKINSERAQHWLSVGAQPTEAVAALLKVTGDWQKFKGIEGAEGTLRVAEPKPSKLELFNQALSEANNGPTAEAITEKKKKAREDKEAKEAAEKAAAEKAAAAESEEAPAEEAAAEEA

SEQ ID NO: 5752 - protein, 192 aa, Corynebacterium glutamicum
MVSSCQITTVYRAILWQCTQLITHLLIQRVDLNSVLPIASGNDDRNLIRYVDGGRFDEIMLTGDLTGLSSFLTNAGPNARDDFDLTVLMRAAEAGNLMVVARLLDLGANPRLTNPRGVTALHIAAIAGDDGIVECLIDAGAEVDAVDDQGRTPLWNAAAHHLPDSAVVDVLLRAGANVNLRDCNGVSPEDML

SEQ ID NO: 5753 - protein, 289 aa, Corynebacterium glutamicum
MITVLTRRHLRCFFRDRMAVLFSIMGALILLVLYVLFLGKLQIDGLMVDLPDSARDDVEGFVFNWVFSGILITSAITVPQAALGVLVEDRTRGGIKDFLVAPVSRTTLTVSYIFAAVIVAMTILIFEIVVGSIGLAILGHFSMSIARVLELVVALLLLTLVFSAIAAFLITLVKSQGGMSALSSLVGTLAGFLSAAYIPPIALPEAVTNVLNFLPFTPAGMLIRQIVVAPALDAISLPPEAFDIFQFGYGLKLEMFGEPVSTWVAVGIVASWGVVFGLIAAFKMKSVVR

SEQ ID NO: 5754 - protein, 292 aa, Corynebacterium glutamicum
MSPILKVRDLVKRYGDTVAVDGLNFDVSQGEIFAFLGENGAGKTTTISCLIGIDQATSGEIELQGGQVDSEKLGVVFQQSVLDPLLSAKENLETRGQLYPGVGKQRVAQLIEQIGMEGFADRRYGVLSGGEKRRTDIARALLHSPDILFLDEPTAGLDPRSRRQVWDTINSLRNDVGLTVFLTTHYMEETELADSVLIIDRGKEVASGTPMELRARYTTTELTLRTNDPTHSGKELAHLSPEIDGDRLRIKLENGLEAARLATELDGVLDVEIRHGSMDDVFLAVTAERKRS

SEQ ID NO: 5755 - protein, 547 aa, Corynebacterium glutamicum
MFESLSDRLNSALSGLRGKGKLTEADINATTREIRLALLEADVSLTVVRAFINRIKERAVGAEVSQALNPAQQVIKIVNEELVQILGGETRRLSLAKNPPTVIMLAGLQGAGKTTLAGKLSKHLVKQGHTPMLVACDLQRPGAVQQLQIVGERAGVTTFAPDPGTSIDSLEHEMGTSHGDPVEVARAGIEEAKRTQHDIVIVDTAGRLGIDETLMTQARNIREAINPDEVLFVIDSMIGQDAVDTAEAFRDGVDFTGVVLTKLDGDARGGAALSIREVTGKPIMFASTGEKLDDFDVFHPERMASRILGMGDVLSLIEQAEAVMDQEKAEVAAQKLGSGELTLEDFLDQMLMIRRMGPIGNILKMLPGGKQMSQMADMVDEKQLDRIQAIIRGMTPAERDNPKILNASRRKRIANGSGVTVSEVNKLVERFFEARKMMGQMAGQFGMGPGSRSATKKQAKGRKGKNGKRKPAKKGPTQPKMPMGGMPGMPGMPGMGGAGMPDLAELQKQLGGAGGGMGGLGGGLPGMPKPPKGMENIDLNNLDFGKK

SEQ ID NO: 5756 - protein, 211 aa, Corynebacterium glutamicum
MRLAALATISAPTCSCGRGKPLPMSWYKAPKTKRSGRATVTVSSAHPATVFRLCSSMVEIWLGSRGISPLMRSHSGTKRDHNPWRSIFFTTRREFFGLERIRKKSPAALAGHGSGSGGHSLSRTQVDSATGSPVVAAAAATRSGSAGSLRSGFLDNSMVPLASTTSRSSGRREAFLNAKPVRRGKMPRAVASAVVRPSSMARAASAISRPR

SEQ ID NO: 5757 - protein, 139 aa, Corynebacterium glutamicum
MAQLGWIIHKFLKGCFAALTGTNTNQLFDVSHPHFAVADFAGACGLDDNVDDFLSLSIGDNNFNLDLRHKIDSVFSTTVHLGVAFLLAKALGFGDSHALHTCLLESIFNVGEGKRLDNCGDEFHDRLLQKDIRNNVRVV

SEQ ID NO: 5758 - protein, 223 aa, Corynebacterium glutamicum
MPCCSTSSSTRHPTVAFRANAMSAVITPAKTTATSAMTIWTIKSLSPSMPPPLNHPMSVARSPTPTVPHRPATRCTPTTSRESSKPKRYFSPTPKHAKMPPIAPRIREVTGVSAPAAGVIATRPATTPEAAPKEVACPSRNFSVANQPSIAAAVAAVVFTQARPARPSAANAEPPLNPNQPNHNSAAPSMTMGRLCGLAIALPNVFRLPTIKASTRAAVPAEM

SEQ ID NO: 5759 - protein, 510 aa, Corynebacterium glutamicum
MLREGQDLGAPKAETTPIVPPVVIPPAAPEEEKAPEQSTETFAAQKPAEEAPATPEPETSDDVVEEPEVKEPEVKEVVAVEPEVETEEPAVVEEPAVAEEPAIVEEPAVAEEPAVAEEPAVAEEPAIVEEPAVAEEPAVVEEPAVAEVPETIEEPAVEELAAVAEVTEAAEAAQVAVESAEAALEETPVPDVEPEPAAEPIDEIVPAAGRIGKLRGRLSRSQSVFGKSVLGILSAGDLDEDAWEDIEAMLIKADLGAKITARVVDELRDKIAEHGVGSEAEARAMLRASLIDACRPDLDRSIKAMPYEGKPAVVLVVGVNGTGKTTTTGKLARVLVSMGHKVILGAADTFRAAAADQLETWGRRVGAETVRGAEGADPASIAFDAVAKGVERQADVVLVDTAGRLHTSTGLMDQLGKVKRVVEKKAVVDEVLLVLDATVGQNGMQQARIFREVVDITGVVLTKLDGTAKGGIVFQVQEELGVPVKLVGLGEGADDLAPFEVEGFVDALLG

SEQ ID NO: 5760 - protein, 53 aa, Corynebacterium glutamicum
MSEVLARLSGFLFDKPDTRDKNSGISDSLACLSGLIGYWQAETKPQCPPNADF

SEQ ID NO: 5761 - protein, 234 aa, Corynebacterium glutamicum
MARRSSTAVLIKPSVWRTSRSASRFLKVSNTAMRRVLSSISGPGTMSALLKNMSSRAFCWVSFMPAIATVDWSMHAVSKVESRPVARVDRMFLPATSSSCPRIGSSGVRLPSSSASLNALGSAPRSCRVPIHAVRCTSVAGDSVVNGEAASPEEMTFPGSACAGTSEADRPFSAAAGEERRAAWTTGRCSVFPCSVQIWETSQSAGTTASLIGGSSTSPPKNAESCAYSSVCAE

SEQ ID NO: 5762 - protein, 1131 aa, Corynebacterium glutamicum
MRGESVYMPAGIADMTDSLLGWASQTELDLNQRLAGVEYFPQIQLRHDELERIHRFYGTFLSRQVGAGASLGDLFEMTPCLTVTTLVSRASRISDPADFFGEYIGGLGLSAEHAAVVEGLTEKLFAQAGLLVPEGIASPLELLSIHAGISNHEVAAVLTEVENGTTEYPFMFDAVLRLTPEWAQTLIGGVQELIEFATTHRTSWSDRQRESSLPAMIDEIVVAELRERPVGTADRENSVGVALRELRPRLILDAERRKVCLRLPEQRVSDDEINWRVSLEGTTRIFSTRRAWGDTSGYSEALDITVERQIRETTVTDTSNQITWVVPVVDFNDPVLVFSARGENLTDKVSLHHQEIYVLAPAEAKLEDMVTGQPVPVIEQFLVEGWNSWVCSRVDARGLSSLKVNKEVRCIDPRRRVAFHHPAELVPHVRSISGLPVHAQSLIAEFPPTLSGQDETWMLSISAFAGVGAAGEEIAEPEPLEVPADGGLFAIFDPEIYDAPWVGEYLVRLRGPRNESFRHEFAIVEDMTTEFEVASGASFRIPTTTGLSEASLRVRSGEKHFTAEPRLVTVEATDPNASFVVTTDEGDQMPLRFVPPQIAIELPLTTEPPTWRVTRTVCGPRDLDGAGELRIRTGVDVGDPKVSVRNHHGSPLRTVKMVTPDNGRTWIASMKEIAASTFVMPRGSIEFEWTDRKVDRRVSVTIAVIDKTENFTGITIEDGKLVFEELAAGRQLAAWVWPQTAPWVSAVELAVTGPELELPEVLVGAGNLIVQLHTADPFTTSVTPLSPGKAAVTVEQEGYYSAQTEEYAQLSAFFGGEVEEPPISDAVVPALWDVSHIWTEQGNTEHLPVVHAALRSSPAAALKGLSASLVPAQALPGKVISSGLAASPFTTESPATEVHRTAWIGTLQLLGALPSAFKEAEELGNRTPLLPILGQLEEVAGKNILSTLATGRDSTLDTACIDQSTVAIAGMNETQQKALLDMFFSNADIVPGPLMEDNTRLMAVFETFKKRDALREVLQTEGLIKTAVELLRAMRGTQRQLYSSARIRFDKLDGVNTDNPENMWALTPVVSLVFALSSRLHAHELIGKTRTLDRASAGWGRIADLVPDLVTGDLISAEAMVLGARNPGLVD

SEQ ID NO: 5763 - protein, 321 aa, Corynebacterium glutamicum
MQASNMADALGFGGLMLFVQAREIAGDGIPGHVEFAQGCGAGSHLDASVVGSVEGAIKSAGNVVQGGRGRSKLSFCFLNLSCDFHSRGFGADLNPPSADEHTIAVNGTQTGIILDCLAAEGGVVDKHNVGKQPVYRAGNRRIQINMVEQPARPGRNVRVQAPCAASLRAINDDGACNAGVDKLLDEPFRSLASQRLGMRTQGGSESLIDVSLRSNQRGQLRVIHHISSIGTWPILVKRLNARLQPGYFFFQIAALSTKLLKTSLCCFGFMFCLFEGFFQGRTIRVNALFTLIGEATFTFHIQNAADELLKLLTESLSFLLC

SEQ ID NO: 5764 - protein, 1155 aa, Corynebacterium glutamicum
MYLKSLTLKGFKSFASATTLKFEPGICAVVGPNGSGKSNVVDALAWVMGEGSAKTLRGGKMEDVIFAGAGDRKPLGRAEVTLTIDNSDGALPIEYTEVSVTRRMFRDGASEYEINGAKARLMDIQELLSDTGIGREMHIMVGQGKLAEILESRPEERRAYIEEAAGVLKHRRRKEKAQRKLQGMQVNLDRLQDLTHELAKQLKPLARQAEAAQRAATVQADLRDARFQIAGFEIVKLSEKLETSTEREKMIREQAEAAQEQLEEATTTQMEVEMELAEITPQAEAAQQLWFDLSSLAERVSATMRIAADRASSGAADVPYAGQDPDELLGRAETADKELEELEMAVEMTTERLTSIQEEAEDKAAQAREAEREHLAQVRAISDRREGVVRLLASEESLRTQHTSAEEEAERLSEQLEEFIGRILDVERERRLTDERKQGVDTDRAPLEEALKQAKHEAEAAETRLEELRTKRSDLEKEVSRLQSRIETLNQNRPRSDAADVVDYPQLATLIRPQRNVDKALAAALGAHAEALAGEAAEGLVEKLIDAGVARTIIVDGTQAGGAWRLDANIPAGASWLLDHVDLDPAIAGPVNRLLADVVLVDDPSLGRQAIEDDPRLRAVDRNGVLIGAGWIQVGTETSTVEITAQIEEAEAQLAAASAALDDIAGTFDGALHAADNTRVEVAARTAALRELDMTRDSITRDLARLDKQHEAAESERVRHVGRLHAAETRREELREQLEDIVDRLSRVEDEEDADEPSTTARDQANAELQQIRAMEMEARLAQRTAEERAGQQRGKGDSLRRQAEHERQAKIRHEQAMEARRRRTQLAAAVQNGARDVAERVSAALAQAAIERDQHNRDKALLTSHLARAKDAVSAARQHLNRLSDNAHSMELARSQAQVRMEEAVAKITEQLGIPVAELLRDYTPDENFDEKFQRARLKQAEKDLAALGKVNPLALEEFKALEERYEFLSTQLADVEQARADLSGVIEEVDAKILQLFTDAWNDVEAEFPRVFNTLFPGGEGKLILTEPDDLLATGIEVEARPPGKRVKRLSLLSGGEKSLTALAMLVAIFRARPSPFYVMDEVEAALDDVNLRRLIALFEELRRDSQLIVITHQKPTMDVANVLYGVTMRGDGVTRVISQRMEPASAMETVAG

SEQ ID NO: 5765 - protein, 94 aa, Corynebacterium glutamicum
MEKVRLTAFVHGHVQGVGFRWWTTSQARELKLAGSASNLSDGRVCVVAEGPQTQCEELLRRLKENPSSYRRPGHVDTVIEQWGEPRDVEGFVER

SEQ ID NO: 5766 - protein, 618 aa, Corynebacterium glutamicum
MESGAIVTTPTLVYLHGVGRGDLKQEWKDQLSQGLARIGFPSLDDVTVLNPVYADDLWEDPEAQHNFAVPPVQKHMTLSGLELLEFERRTAAMETRLGRHNRGAGGAFPEAVVSRSVELPLFVQARNFLNNQQIRAQVHRRILEQLPTEGEIVLLGHSLGSVIAADLLRRLPPELTVKGFVTIGSPLANGQFNVDDLFKLLRTPLSNVSWWVNFWSGSDPVAAKRGVSVAVPWVLDFRVKTSLVPGPGHSSREYCANDAVAEAIGFGLFGSRSKEIVLAEKNLQIPLNDAEIFVLQALRYCYLILQRLKGDEALRYEYALRETQDRLIEEIKSRNAEEGRPIPKEIARLDFDNGDPNAAAPVPGLSPFMPKEQAIERLLEIIGQNLLLPFEIEVPEKIQREALRDFTAETQLGSTVGADIFDALQMAVGVVSGSAKSNWRKWGAFGVGAAALTAATGGLALAAVPTVAGVATVASTLAAFGPGGMMGGLVTAGTLLTVGGGSLTAGVLSSVNTTEEIEALVVQKLSLAILWQRHEIDRTHEVWEEFAEAERLIVREHTRVKNVSDSSSPILKAFEQQRSTIERALKYLSDHGMEPGWFEELEPPAPTPFLKLRAKKTD

SEQ ID NO: 5767 - protein, 286 aa, Corynebacterium glutamicum
MSIDLRDIKLLVAAVDCRSITGGAQAVGLSLSAASSRITALEKKHGVSLLQRLRSGVVPTEAGEVVLIQSRRLLEQADLLTSAFQQHQKTHIKLVSNTSAVDSLTEFLAATLNKYPELNVDLEEESSSEVARRVREGTADLGVVSVLESRTGLEAHLLWEDPLMIVSTSAKTSVEALKGPMIGLSAGIPLQTYIDAHLRRDGITPNYRVRLPTLSAVYAVASTGAGSAILPLGTTRRLGIRTKNVLPIEEPWAQRDAWMLVKEGRTLADVEKSFIDALLSFRDEES

SEQ ID NO: 5768 - protein, 277 aa, Corynebacterium glutamicum
MCRNSEADMSIEWLQIVELGAIFGAGFLAGSINVIVGAGTLVSFPILVFLGLPPLTATIANTIGIVPGSISGVVAYRRELHAHVKTIRFLLPASILGGITGASLLLHFSADVFTAVIPWLIGFGTLLVIAGPSIKKHVGAHTSGGISAGFRQLPFPSRTTFIVSVCGALLLGMYGGYFSAAQGILLIALLGITSTLQMQELNAIKNLTVAAVNLIAASVFIIISPELISWPTVALIALGSALGGYIGGRYARRLRPSVFRAFVVIVGITTVIVMTIG

SEQ ID NO: 5769 - protein, 61 aa, Corynebacterium glutamicum
MKGTTSMLAVPTSVINARTTSRAITAAAQKRASESLEFSSPEHSNCHSNLDIPEIPVYRDA

SEQ ID NO: 5770 - protein, 149 aa, Corynebacterium glutamicum
MSFSGFEQFIGLVANRYGKPGTPHSEEQHSDYEAGTVLLGSETWHIRTARVTPTKPGAFVAFWMRNEQGEICPFDSSEACAGLLIFVQDESNFGVFRFTREQLEQQGITRSTKRPGKRGFRVYPSWSGNLNAQAKKTQAIQTPSFELLQ

SEQ ID NO: 5771 - protein, 205 aa, Corynebacterium glutamicum
MSEAFDATKVRKAVLTVALLNFAYFFVEFFIALSAGSVSLLADSVDFLEDTSINLLIFIALGWPLARRAVMGKLMAIVILAPAAFAAWAAIQRFSAPQAPEVFPIIVASLGAVVINGASAIIISRVRQHGGSLGQAAFLSARNDVLINIAIIMMALITAWTTSGWPDLILGCFIILLALHAAHEVWEVSEEERLASKALAGEAID

SEQ ID NO: 5772 - protein, 286 aa, Corynebacterium glutamicum
MPELPEVEVVRRGLEDHMVGHTIVSATVLHPRAARNQLGGGPEIEANIAGLRVSAAKRRGKFLWLELIDAPSGETRPDLGLLVHLGMSGQMLIKEPDAPISPHLRAKVELDNGDEVWFVDQRTFGYWWLGDLVDGVPERVSHIATDVLDESADFSAIARNLKSRKSEIKRLLLNQEIVSGIGNIYADEMLWQAKIHPLQRADRLSLARLEELLQAGKDVMTKALAQGGTSFDALYVNVNGNSGYFALSLNAYAQTGEPCGRCGTLIIRESFMNRGSHYCPNCQKRR

SEQ ID NO: 5773 - protein, 247 aa, Corynebacterium glutamicum
MSRKKNRLTGVDALNEAFDAVDHQPLLDHLGVDIQRDLLVLALTHRSFANENGMLPNNERLEFLGDAVLGLSVANKLYEQYPSSPESDVSKMRASIVSRYGLADIAREIDLGNHILLGKGELLTEGRSKDSILADTTEALFGAIFRQHGFETARDVILRLFAYKIDNASARGIHQDWKTTLQEELAQRKRPMAEYSATSVGPDHDLVFTAIVTLEGEEMGRGEGPNKKLAEQEAAHQAFRKLRESRA

SEQ ID NO: 5774 - protein, 178 aa, Corynebacterium glutamicum
MKSPFIFDVAALLRGSALPEHLTQSGPSPTRIGPEMIAIPEGGKVIVEAQIIPLGGGLAVEADIEAQLLGQCSRCLRELTPTKTLHVSEVFAADPDFVTGEDAADDEDELPMVNQDQIDLLQSVIDEAGLTLPFNPVCEELGYGACQDDETPAPDGVSEEVEDEEKVDPRWAGLEKFL

SEQ ID NO: 5775 - protein, 263 aa, Corynebacterium glutamicum
MYKVFEALDDLVQAVQRAYGVPMTGNCVVPRQEVLALLDDLRDALPVELDDAQDVLDHRDGVIREAEEKAIALVDDAENEARNLLARATEESDAMVEDATKHAHSVVAKANDTADRIVSDARREANSVTERAQAESERLVNSGNDAYRRAVAEGQAEQDRLVSEAEVVRRSTEEAHRIVDAAHADSNKLRNECDDYVDTKLAEFETSLSTTLRSVTADRSALRRGAGATGRELRDEQPAARGEYERDYERDYERGYERDDRDY

SEQ ID NO: 5776 - protein, 548 aa, Corynebacterium glutamicum
MQKGCGLMRSLLRDIPAVGWLITATIVVRTLVVALVIVGIGLLIDVPSPAHSAMLWWVLAGATAAAALLCAEAVLPQRIRARVERSWRRQLAAKNLELNSSSSDDAQLITLATEATSKASTYTVMFLGPYFAVFLAPLTVIAVVGAAISWPIAGILCLGLCVIPFVISWAQRMLKGAGAGYGRASGQLAGVFLESVRTLGTTMMLNAAGQRRQIITQRAENMRSQVMSLLYRNQLMILVTDGVFGVATTMVAAVFAIGGFFSGSLTLGQAVALVLLARLLIDPINRMGRTFYTGMAGKPSLIAIEKALATTFTDQPTQQGQRHDGDLVVNNLKIARDHRDIVHGISFSIPRGSHIAVVGPSGAGKSSVALALSGLLEFDGAISLGGHNCEMLDLRASVSFVPQSPTLFSGSIKSNIDLARTGVDSDHIHAALLGEELPADLKVGETGKGVSGGQAARISIARGLVKNAAVIVLDEATAQLDYTNARQVRHLAKSLECTLVEITHRPSEALDADFIIVLEDGQLTMMDTPSNVSQHNAFFRTAVMEEEQ

SEQ ID NO: 5777 - protein, 510 aa, Corynebacterium glutamicum
MISRLLQLAKKVWPELGASTLLRLLNQLLTAALIVFPAWVLSRKPDISLLAVAIIMALIALTAAVCRWGEQVCGHRAAFGLLAHMRVMLYDALVHKGSPSPIHGSGSIMSVATRDINSIEVFFAHTIGPTVTAVLLSAGGVITLATLDPVAGLIGLLGVLIAWLIPLIGKQSSSSEATSRGHIAQHLTEDAAGRLEINSHGAQATRLNALEVKEQQLEQVVTRQGLIVGIRQGAALLWPWISAVLLVALVPHVGIVAAAIILGISPALDAVEGFARTMPTALNSAQRYFQIIDAPVAIAEPDEPKPLPKGPLKLRISRVPVSAKGTVSLEVAAGEHIGIIGSSGSGKSTLAKLILKLAQLRSGTITIGGVDIAEVSSAELRKSVTLVEQKSVLFRASVLENLRMGNPELSEDEAREALRLASISELPLDADALRLSGGQQQRLCLARALARTPQVLIVDEATSHQDALNQADLSQTLATLKDTTVIIIAHRTAALTHVDRIIDLEEIKNP

SEQ ID NO: 5778 - protein, 374 aa, Corynebacterium glutamicum
MSNSPTDVSTSAPRIMIAPDSYKGTATASEAAQYLGEGVLEILPNASITLAPMADGGEGTSSVFGGQVITLPTTNAAGRLTEASYTLDSETNTAYIDIAAASGLPAVADDLVPTTGDTYGTGVLIADAVTRGATRIALGLGGSATTDAGSGILIALGAVPRNKEGYALRTGGADLINLDYIDTAELNIPAAAVEWILLTDVDAPATGPQGAATVFGPQKGATEKDISLLDAALHHACAQLEVDGTKPGMGAAGGIAIGLTWLSTLMHGNDQQIHILPGAPLIARSNGIEDALPETDLLITGEGRLDSQSFTGKVVGTLHGLAKAHDVDLAVAAGIVEGGIPDDFLAVEMIKSSDVAAQLRDAGRRIAQEYVAQN

SEQ ID NO: 5779 - protein, 147 aa, Corynebacterium glutamicum
MGASHNTKAIVYCGVMPKIQFDVLVPDTDSIALAGRFTVVANLLIEKGLMDHGVVVHDPAAKIAEAVEEQLRQTYRDEHEDADLEESSVNRYLIEVDGVKGSVNQVTMIFARLLTPPAELPKDAFLLEQELAYEVPAVYPWTVEILR

SEQ ID NO: 5780 - protein, 428 aa, Corynebacterium glutamicum
MADGTIKQIHPFTGTEVWTVPGRGNRPLSHPASTIVELSAHDHTSYCAFCSDNMLSTPPEKSRIIIDSSGDFDILPGALPGELSETTPEFRRVPNLFEIVSFDYWHQNFGFDMDSETAMRMAQYLAIPEGREHVLAIVRTRLSAAGEDPAHMTDGELLEKAPSYFAGGHDVIIGRRHFVDDATTSDQLASSGTLTVKEHEAFIRLTVDGIRDLYHRNRYAPYVVAFQNWLKPAGASFDHLHKQLVAIDERGRLIADELHHLRGNPNMYNELAVDYAGYHNLIIAENDHAVAFAGFGHRYPTIEIYSKSAIPEPWLQSDEEIQAMSNLIHACHAATGADVPCNEEWVHKPIDVDMPMPWHVMIKWRVSTLAGFEGGTKVYLNTLSPHKVRDRVVKEMYRLRDEELIASDLRIAMECSVERNSLKYNPLL

SEQ ID NO: 5781 - protein, 421 aa, Corynebacterium glutamicum
MSRISELLNNHGVDLSWQEAAYQDFHEHPELSGFESETADRIQKYLERFDCEVIPNVGGYGILAVFRNGSTDPGAPVALMRADFDGLPVKEITGVPFASTRMRPHDGANVHVMHACGHDVHVTALLGACAILDERRDAWEGTFIALFQPSEENSQGANKMVAGGLVDLIPRPDVCFGQHVVPGAAGTVMSMPGGALAACDSIEIRIQGRSAHGSMPHNSIDPTYVAAMIVVRLQGIVGREVSPEDFAVISVGTLQSGNTNNTIPASARLVLNCRFYNDKVKHKVYRAIERVVRGECLASGIEEEPVIEYFAHGDLTNNTPVVFDTVRPVFDDVFGEDSIDAYRWTASEDFPSIPKAFNSPYLYWTIGVTPRDQWTEAVERDRVASDVPANHMGDFLPDYAPTMSAATRAAAAALLTYLGTN

SEQ ID NO: 5782 - protein, 112 aa, Corynebacterium glutamicum
MNILFIPILAALIGYFVRSRLSAVVLFLAIESIFFTFQTLAVFLAWMAGDGGFGGATDQGAFGLTPSGLPLKFNDLDLWLYGLVNFALIAIGVALTIAVVSFRIRRRRKLDD

SEQ ID NO: 5783 - protein, 45 aa, Corynebacterium glutamicum
MSKAGSYVAVAKDVLSFSRPIPALHAIIGALGWFGMFAVCLWSTL

SEQ ID NO: 5784 - protein, 92 aa, Corynebacterium glutamicum
MFPIGFFAGVVLIFLGATAGLGIASLAKWWQHRSQDFPEKKVTTHIVLQSTSIVMWVVFMVFMQPWIAWLTFATITVGQVFGDLLMFSSYRA

SEQ ID NO: 5785 - protein, 850 aa, Corynebacterium glutamicum
MKPVGTVQFKNQLPTQLQPLVKLAHNLRWSWREEAKQLFRDIDPELWEQLDEDPKQMLLQAPATRLQFLAGDDEYLGRVNAEEQNLSEYLSDKLWYQDTADATDAVGDPLVAYFSMEFGIHPSLPIYSGGLGVLAGENMKSASDLGVPLIGVGLLYTHGYFTQSLSGDGWQQEEYKYHDPAELPIEAVKDKNGEQVTVSVTYPGAQEVKIALWVANVGRIPLLLLDTNIEANPEELRNVTDRLYGGDNEHRIKQELVLGVGGVRAVNAFCEARGLKRSSVAHLNEGHAGFLTLERIRERIAEGMEYPAAFEQVRASNIFTTHTPVPAGIDRFDMEMVRRYLGGGQPEDQQLCVGVPIEKALELGQESDPHRFNMAHMGLRASQHANGVAKLHGEVSRDMFAGLYPGYEPREVPIGHVTNGVHLPTWVKPEMKELIDRVTGGADLAVADSWSNPQAVESEKIWKVRNKFRADLVEVARAATAKSWSHRGHTEAELAWTSRVLDPNVLTIGFARRVSTYKRLTLMLRNPERLRSILLNEERPVQFVIAGKAHPHDMGGKKLMQEIVHFADQAGVRDRFLFLPDYDINLASYLISGADVWLNNPVRPQEASGTSGMKAVMNGGLTLSISDGWWDEMPKETTGWTIPTVESQDLECRDHLESQALYDLLENEVAPLFYKRDKNGIPQDWLDLVRESWTTLSPMVTSTRMVRDYTTQYYRPTKHQAELIAQPAEAADYAAWLEHIKAEWAGVKVSDLKISESAITAQELEVSVRVDSGSLNDDEFQAQALFGALGHNGDIEDPEITVLTPRGDGAYAAKVSTDLPGNYGITARVVPNNRMLVSPAETRLITYLEN

SEQ ID NO: 5786 - protein, 300 aa, Corynebacterium glutamicum
MALLEQSINSDTFMDAVSLRVGDLEGMTSYYSSILSVEPMEEKVHGKEVHRVLGRNGTPLLRLISTPGLPAVDPRQAGLYHTAFLFDTQESLAATVYRAAQESRSRFVGSSDHLVSEAFYFTDPEGNGIELYVDRPRSAWKYADNGDVRMDTIYLDPNQYLQSHLSETVLNNTAILPASIGHVHLQVGNVERARQFYVDKIGFDATTSIPNALFASAGGYHHHVAMNTWNSAGAGPRAATLGLADVAVIVPVREDLDMLVSRLKGEEFFDNGTSVVTRDPWGTHITVSLPGVSTDELLNR

SEQ ID NO: 5787 - protein, 316 aa, Corynebacterium glutamicum
MTLATIPSPPQGVWYLGPIPIRAYAMCIIAGIIVAIWLTRKRYAARGGNPEIVLDAAIVAVPAGIIGGRIYHVITDNQKYFCDTCNPVDAFKITNGGLGIWGAVILGGLAVAVFFRYKKLPLAPFADAVAPAVILAQGIGRLGNWFNQELYGAETTVPWALEIYYRVDENGKFAPVTGTSTGEVMATVHPTFLYELLWNLLIFALLMWADKRFKLGHGRVFALYVAGYTLGRFWIEQMRVDEATLIGGIRINTIVSAVVFAGAIIVFFLLKKGRETPEEVDPTFAASVAADAVASPDGKPLPKAGEGIDGETPSTR

SEQ ID NO: 5788 - protein, 267 aa, Corynebacterium glutamicum
MEGGWGMVATENRMLMEIAAEISAREATLGFQEVKTKSRSAGLTAAFDIASVFFSSGCNVVVAFDRFASNWSDHSDHVDYAAQVAGFGASMLAYTVRRGQFDTAVRDIRDIKSEVDIPILLHDPIIDPYQIHEARVMGIDALQFPVWAMEQARLESLVDRTESLGMTAIVSVRNHEEAHRAVDAGATVVAIDITGYTGSLTLPEAFSGITQFMPKEVARIVLGGCSSPKELMRFARHSADAIFVPHADLATTKSLVTAGMHPACPSR

SEQ ID NO: 5789 - protein, 219 aa, Corynebacterium glutamicum
MKPRVLSALGIGAGALVVWISSRMNWVTIEAFDDKSGSVTQSIVGATWSTEIMALALALLAAFAAALVLKRMGRRIIGGISALIAVGASLSPLALLTQDPDAERARTLLTSGVASQKANSGTLLSDWAEIINTTTHPLAAVVAMIGCALALVGGVVLAMRPGEDTAKSNQYERKQARAEKIHTDLAQDPDSGRVMWDALDEDIDFTEKTQKSKETPGQS

SEQ ID NO: 5790 - protein, 118 aa, Corynebacterium glutamicum
MSDNPQEYELDWDVEKRLKLNDAGLVPAIVQADGTNEVLMMAWMDTHALAYTLATRRGTYFSRSRNEYWIKGLTSGNVQEVTGLALDCDGDTVLLTVKQTGGACHTGAHTCFDNDVLL

SEQ ID NO: 5791 - protein, 258 aa, Corynebacterium glutamicum
MGVAIRVIPCLDVDNGRVVKGVNFENLRDAGDPVELAKRYDEEGADELTFLDVTASKHGRGTMLDVVRRTADQVFIPLTVGGGVRSEEDVDQLLRAGADKVSVNTSAIARPELLSELSKRFGAQCIVLSVDARRVPEGGTPQPSGFEVTTHGGSKSAELDAIEWAKRGEELGVGEILLNSMDGDGTKNGFDLELLEKVRAAVSIPVIASGGAGKAEHFPPAVAAGANAVLAATIFHFREVTIAEVKGAIKDAGFEVRK

SEQ ID NO: 5792 - protein, 275 aa, Corynebacterium glutamicum
MDARGMLAIAEAVVDDAEALFMQGFGAAPAHMKSPGDFATEVDMAIESHMRSMLNMMTGIAVIGEEGGGATSGTRWVIDPIDGTANFAASNPMSAILVSLLVDDQPVLGITSMPMLGKRLTAFEGSPLMINGEPQEPLQEQSSLVSHIGFSSMASPRNTAFPVELRRDLLTELTESYLRPRITGSVGVDLAFTAQGIFGACVSFSPHVWDNSAGVMLMRAAGAQVTDTEGHPWAPGRGVVAGTKRAHDVLLSKIEKVRLMHADAGNDQSLNEEYK

SEQ ID NO: 5793 - protein, 246 aa, Corynebacterium glutamicum
MTFTILPAVDVVNGQAVRLDQGEAGTEKSYGTPLESALKWQEQGAKWLHFVDLDAAFNRGSNHEMMAEIVGKLDVDVELTGGIRDDESLERALATGARRVNIGTAALEKPEWIASAIQRYGEKIAVDIAVRLEDGEWRTRGNGWVSDGGDLWEVLERLDSQGCARFVVTDVSKDGTLSGPNVELLREVAAATDAPIVASGGISVLEDVLELAKYQDEGIDSVIIGKALYEHKFTLEEALAAVEKLG

SEQ ID NO: 5794 - protein, 211 aa, Corynebacterium glutamicum
MTKTVALLDYGSGNLRSAQRALERAGAEVIVSSDPEVCTNADGLLVPGVGAFDACMKGLKNVFGHRIIGQRLAGGRPVMGICVGMQILFDEGDEHGIKSAGCGEWPGKVERLQAEILPHMGWNTLEMPTNSPMFEGISPDERFYFVHSYGVRKWTLETDDLTTPPEVVWAKHENDRFVAAVENGTLWATQFHPEKSGDAGAQLLRNWINYI

SEQ ID NO: 5795 - protein, 422 aa, Corynebacterium glutamicum
MWKSPGFVAVLVAVAAAFGSWSLLLPVVPLAVLNNGGSSAVAGATTGIFMAATVITQIFTPAALRKIGYTPVMAFAAFMLGVPAIGYIFSVEPIPVLVVSALRGIGFGALTVAESALVAELVPVRFLGKASGMLGVFIGLSQMLFLPAGLALGDQFGYNVVYVLGAVIALVAAVMCLRIPQVKAAAKQQPQVSEQERSVSTWKLVLVPSLAVTSLSMTFGAVSSFLPAAVIELDPGLGAALAGIILSITGGSSMVFRYLSGVIADRRGVPGTTMIPAQIIGFLGVVLITVTIFQGWSVWLLIIGAVMFGGAFGMVQNEALLSMFFRLPRTRVSEASAIWNIAFDSGTGIGSFLLGIVAASLAYSGAFGSGAVVILFGIVLTTADRIIGRHRITEYNNTRARLRQVPVARRAVQGLRNRRKDR

SEQ ID NO: 5796 - protein, 75 aa, Corynebacterium glutamicum
MNSSPISDMVTAAVQNEPDAGDRWFIYGLFLIAGLFFGGAWSAYKSENKILMVAAGLIAVLAVAGGILWLLGEMT

SEQ ID NO: 5797 - protein, 202 aa, Corynebacterium glutamicum
MTVAPRIGTATRTTSESDITVEINLDGTGKVDIDTGLPFFDHMLTAFGVHGSFDLKVHAKGDIEIDAHHTVEDTAIVLGQALLDAIGDKKGIRRFASCQLPMDEALVESVVDISGRPYFVISGEPDHMITSVIGGHYATVINEHFFETLALNSRITLHVICHYGRDPHHITEAEYKAVARALRGAVEMDPRQTGIPSTKGAL

SEQ ID NO: 5798 - protein, 366 aa, Corynebacterium glutamicum
MTKITLSDLPLREELRGEHAYGAPQLNVDIRLNTNENPYPPSEALVADLVATVDKIATELNRYPERDAVELRDELAAYITKQTGVAVTRDNLWAANGSNEILQQLLQAFGGPGRTALGFQPSYSMHPILAKGTHTEFIAVSRGADFRIDMDVALEEIRAKQPDIVFVTTPNNPTGDVTSLDDVERIINVAPGIVIVDEAYAEFSPSPSATTLLEKYPTKLVVSRTMSKAFDFAGGRLGYFVANPAFIDAVMLVRLPYHLSALSQAAAIVALRHSADTLGTVEKLSVERVRVAARLEELGYAVVPSESNFVFFGDFSDQHAAWQAFLDRGVLIRDVGIAGHLRTTIGVPEENDAFLDAAAEIIKLNL

SEQ ID NO: 5799 - protein, 442 aa, Corynebacterium glutamicum
MLNVTDLRGQTPSKSDIRRALPRGGTDVWSVLPIVQPVVEDVQNRGAEAALDYGEKFDHIRPASVRVPAEVIAAAENTLDPLVRESIEESIRRVRKVHAEQKPSEHTTELSPGGTVTERFMPIDRVGLYVPGGNAVYPSSVIMNTVPAQEAGVNSLVVASPPQAEHGGWPHPTILAACSILGVDEVWAVGGGQAVALLAYGDDAAGLEPVDMITGPGNIFVTAAKRLVRGVVGTDSEAGPTEIAVLADASANAVNVAYDLISQAEHDVMAASVLITDSEQLAKDVNREIEARYSITRNAERVAEALRGAQSGIVLVDDISVGIQVADQYAAEHLEIHTENARAVAEQITNAGAIFVGDFSPVPLGDYSAGSNHVLPTSGSARFSAGLSTHTFLRPVNLIEYDEAALKDVSQVVINFANAEDLPAHGEAIRARFENLPTTDEA

SEQ ID NO: 5800 - protein, 400 aa, Corynebacterium glutamicum
MDFTSVNDRNVPAPNTSIPFPVDLNRVTEAVDSLGYHYLSSEDRIIVPWQDHRISMYFSHESGQMLTILGRTRLNLDMFAINDAARAVTEWNAERIGPTALVHLGNDGEVELKFRTTICIDEGLSTQQLRQFINLSLDTTAMAVTYILERFSELNFSDTGSPDDTNNADELSDEQDQADLVEKIRGLYVPTPVEELIESLEDAEWEESDMADEDAEDDYLDDDSEIEWETDDDYFEPEEVDMDELLNGFLEDSDIPQEVTLERIRAQLHAIGVVKTSGEDDFIIAWINEVFLGFFVDNGPTFLVKGHWDPSMDPTRDFMKLFMMCNQWNENSLTTKAFCHTDDKGLQVRVEFAVSVAEGLNDDQLQHNIALSIHHILQAIDSISTEATGSSTVEWPEKNR

SEQ ID NO: 5801 - protein, 217 aa, Corynebacterium glutamicum
MTYPGITSDHNPYDGYTGDDGAGNKRNLPNRKKINKSVGVYAGVFALTLALYAIGGAAWGLLRPTYTAYVEDAETASIAVETNTSFAGYAWFAIATGVLAAAIALFVFLRTPQHRGPVMLLWLGIVSIAGSVAFLVFGNVASTMLHGSPSDYASAIGASFQVAPTITPGVAFGVAPFLSVCMYWCAAFVTPEEEIDQDDAGQGTSKASGSEMTGASG

SEQ ID NO: 5802 - protein, 103 aa, Corynebacterium glutamicum
MMVVASEDSDSDEVVSAASAEVAALDEEEFVVVAALDEAASVSDESLPHAVKRSGVTMSAAKATFFEERLIDKVLLLINHRHAPENLKIPGRFTQITLAKQSS

SEQ ID NO: 5803 - protein, 214 aa, Corynebacterium glutamicum
MSISLSSKKVAFAALMVTPLLLTACGSDSSDTEAASSSAATTTNSSSSSAATSAEAAETTSSESESSEATTINEEQQAQLDVLSQELSENPITFAEAAPVENGETASPEDTAAIEALVRGYTDTNTLRSSLAYTINNTCTRVLEASGADATQLDLNTIPDIPLGGEGTGTVDSITDVVVNGQEASAWVVATAGGTTDSATQRFFNEGGQWKFCD

SEQ ID NO: 5804 - protein, 187 aa, Corynebacterium glutamicum
MQLSKESIIGAAVSILSEFGLSDMTMRRVAKQLNVAPGALYWHFKNKQELIDATSRYLLAPVLGRNDEQRASISAQETCAEMRSLMMQTKDGAEVISAALSNQQLRQELESLISDSLKEPNEVGAFTLLHFVVGAVLTEQTQLQMHEFTAGAGDDTQENPADANFEERFNQGIEIILVGLDALGHIR

SEQ ID NO: 5805 - protein, 836 aa, Corynebacterium glutamicum
MTSTIEHSYQVWPGHAYPLGSTYDGAGTNFALFSDVAERVELCLLDADNNETRIPLEERDAHIWHCYLPGVQPGQRYGFRVHGPWNPDEGKRCDANKLLVDPYARAFDGDFDGHPSLFSYDITNPNDPNGRNTEDSIDHTMKSVVVNPFFDWGNDRAPRIPYNETVIYEAHVKGMTMTHPDVPEELRGTYAGLAHPTIIQYLSDLGVTAIELMPVHQFLQDDRLRDLGMRNYWGYNSFGFFAPYNDYAANKNPGGAVAEFKGLVRSYHEAGLEVILDVVYNHTAEGNHMGPTIAFRGIDNEAYYRLVEGDRRHYMDYTGTGNSLNVRDPHSLQLIMDSLRYWVTEMHVDGFRFDLASTLAREFDDVDRLATFFDLVQQDPVVSQVKLIAEPWDVGEGGYQVGNFPPLWTEWNGKYRDTVRDFWRGEPATLGEFASRLTGSSDLYANNGRRPTASINFVTAHDGFTLNDLVSYNEKHNMANGEDGRDGESHNRSWNCGVEGPTDDPEIMQLRAQQRRNFLTTLLLSQGTPMLSHGDEMARTQNGNNNVYCQDNELAWVNWDQAEENADLVSFTRRLLRIRANHPVFRRRQFLAGGPLGADVRDRDIAWLVPNGTLMTQDDWDFAFGKSLQVFFNGDAIEEPDYRGQKIHDDSFILMFNAHFEPIDFNLPPEHFGMKWKLLVDTTEAVGHPLEDLTIEAGGTITVPARSTMLLRQVEAPDYTKLEEKIAAEKREQELAAEKEAAEKRELELAAAKEAEDAAEALHLAAERASTQEAELAHQHGADAIADEVAEEPQELPQDEVAAEVETEPDTEPDTESDSEQAEVASEEPEADEEEK

SEQ ID NO: 5806 - protein, 267 aa, Corynebacterium glutamicum
MTTKPIIPESTHSAERAGGHWILARLGKKVLRPGGRETTQFLLENLSLTGATVVEFAPGLGVTARDILGKGPARYIGVDSDADACANVRAILPAGPHEVRNTNATDTGLESDSFDVVIGEAMLTMQTDKHKLELMREAARILKPGGLYGIHELSLVPDNVSTAVKEDIAKALARSIKVNARPITVPEWAALAREAGFDVINIRQADMALLSLKRNLKDEGLKGVFTIVRNVISQPDLRKRVLGMRKTFTEHKDHLGAVGIILQKRAQ

SEQ ID NO: 5807 - protein, 258 aa, Corynebacterium glutamicum
MTFKLAACAEMIYQDLPFEERVKTISDQGFLVEIWDWSTKDIDALVATGAEFSSMTGYLRGDLITEQGRAELLATASESLAVAEKLNCPRLNLHGTGLGPQGLPVTPIEVVTPEMWLYAAETLRQIAELGERAGKVFVLENLNLAVDHPGTPFAKATDTLALVKAVNHPNLRLNLDLYHAQIGEGNLIELLREAQPFIGEIQVADVPGRMEPGTGEINYQGVAKALAAMGYDGVIGMEAWASGDSSDALQALKSAFTV

SEQ ID NO: 5808 - protein, 337 aa, Corynebacterium glutamicum
MSVKLALIGAGRIGSNHARLITNHVIGSELVAVVDPTPNAETLADELGAVAFSNPDDVLTRDDIDAVLIATPARTHADLVVKAAAAGKHVFVEKPMAVTLEDADRAINAAREANTVLQVGFNRRFAAGFAAARARIDAGDIGTPQLLRSVTRDPGPFTADPNKIPQWTIFLETLIHDFDALCYLNPGATPVEVTAHADCLVVPEAAGTGFLDTAVVTVRFDNGAIGTAEASFSAAYGYDVRGEVFGSKGMMTAGDARATNMTFYGAEGIAAATSRADTDLLSDAYRAEFQAFVDSIRTNTPSKVPGEAARTALLIALGAIRSVETGATINLAESIEV

SEQ ID NO: 5809 - protein, 332 aa, Corynebacterium glutamicum
MASKRPTMADVAKAAGVSTALVSIVFRDAPGASESTRNHVKEKAAELGYIPDRRAQKLRQNRSGLIGVAFEMHQAFHGDIVEHLYPTARKHGFDLYLSAITPTRTEKDAVNALIRERCEAVILLGSRMSPSDLETIAQQLPVQVIARGSGTPKVSSVHVDDAVGAQLALNHLIELGHEHIIYIDGGDAPGTQERSEVFKAHIDSFAGTTRIVPGGSSEAAGAQAISEILDSGTDATAILAFNDRVALGVLDILWQRGIHVPEEISVVGYDNSSLASLDHIGLTTIAQDSEAIAAKAIDVTINQINNHTETSAVLTPTLITRRTTGPRPQKAI

SEQ ID NO: 5810 - protein, 266 aa, Corynebacterium glutamicum
MAIIECEDITVRHPHAPTPAVSGLSTFVEQGEWLNIVGPNGCGKSTLLHAFAQVLSLESGRLKMGEGDVEKHFAFGLKAAKQRRFFARTVALMPQNPTIPAGLSVFDYVLLGRHPHSYAPGRADDEIVKRCLADLKLEHFSDRGLDELSGGERQRVSLARALAQEPRIVLLDEPTSALDIGHAQETLELIDAIRHRLGLTVIAAMHDLTLTAQYGDRVLMMNGGRKVFEGTAAEVLTAQRISEIYDATVIVEVIDGRPVVIPQRSH

SEQ ID NO: 5811 - protein, 346 aa, Corynebacterium glutamicum
MLKRIFLNPWVATALSVVILGFVVLFSGFSGVIDLSPTAVIRHLSGQDTLTPRDQAIFFDIRLPRIIAGVIVGATLAISGASYQAVFRNPLADPYLLGVSAGSGLGVTAVIVGGTVLGFSAPSIGVIGAAFVGGVAAVLATLMVSRGVGQGSSTTVVILAGVAVAAFASSIQTYIQQRHIDTVARVYVWMLGNLNVTNWMSIFIVAVVAGLCAAVIMSCARLLDVMAVGDVEARTLGVDPGLVRIGIVIVATLGTAAVVSISGLIGFVGIIVPHALRLIVGPGHRILLPLSFVWGAIFLVLADTAGRTLMAPQELPVGVVTAALGAPFFLFILRRTSRQRVPKRSA

SEQ ID NO: 5812 - protein, 116 aa, Corynebacterium glutamicum
MFTVSEQTYIGQIYDMFGLTSIADGGDAYSQLSNEAIIAANPDLIFLSDAKAENLTAEDIAARPGWDTIDAVANGRIYILDDDIASRWGPRVSQLVEEIAAQLNQLASSEAVPAAA

SEQ ID NO: 5813 - protein, 198 aa, Corynebacterium glutamicum
MVSTTTSRSIAGLSVLVATALIAGCSSAEDGTVDSGSSTEVTTTQSKEGFPVTVTFAPEAPVTIEDQPERIVSLSPAITETLFAVGAGDHVVAVDEYSNYPEDAPLVQGLSGFTPNVESILDYDPDLVVLMSADDSILTGLDAAGVDTLVIPAAENLDETYSQIEQVGRATGFEDQATTVVDQMKTAIDAAVATFLKR

SEQ ID NO: 5814 - protein, 147 aa, Corynebacterium glutamicum
MNVQFESDMAVQPGNTMEATVTDIRDAKRKTTQLDSVTPFKKNCPSRTLLDTISDKWAVLILLSMENGPQRNGEIKDQVQGITPKMLTQRLGVLVEDGLVTRTSHAVVPPRVDYQLTDLGASVIEPCRAMYSWAVENIKQVEAYRSA

SEQ ID NO: 5815 - protein, 381 aa, Corynebacterium glutamicum
MLKGEKPQHLGGGAPVVPSAPSTVAGLNFVGFDVETANDDWGSICQIGLVKYVDGVEESSESWLCTPPESLNFFNEINIGIHGITPEMVADQPRFADLVPKMVEFVGDLPLVAHNAQFDFTALSRACAASGIDVPEMIYGCSLTLARNEKLQVENHKLPTVASHLGFELKNHHDAAEDARACAAITIALAKRHSFEGSFVDFVHSRGFTMGTVDNARVYPVLKDRSGANVALQRRNFGLDAGKTEVPVQPAVDPAWETPKAEPKKQSGRRAPWDKVATPEVIPDPNPDADPSSILYGQNVTLTGDFEPYEKGALWQRIADQGALIGKNVTKKTTILVAGPWATITSKQKRAEELKEKGQDIQIWDEKQLFTALGLDEQPPF

SEQ ID NO: 5816 - protein, 202 aa, Corynebacterium glutamicum
MKVPIRASKIQPRLHNHQWAHTARLSTDGFCDNPAMLNLSHDLCMGLHSGKVTLSYRALAEVGLTTRQAWDQSATNLLKCATTPEGIRFDLRDAETTTTIASSALEIRVPGAPITAWLAHPQTFTVLNRHLELRLGPAPLYLAPNSHTLIAIPAGDPGIFEFERWARSLLEVGGVEGIVDKLLVYRHGFPCPYQPAFVALAA

SEQ ID NO: 5817 - protein, 811 aa, Corynebacterium glutamicum
MARPISATYRLQMRGPQADSAGRSFGFAQAKAQLPYLKKLGISHLYLSPIFTAMPDSNHGYDVIDPTTINEELGGMEGLRDLAAATHELGMGIIIDIVPNHLGVAVPHLNPWWWDVLKNGKDSAFEFYFDIDWHEDNGSGGKLGMPILGAEGDEDKLEFAELDGEKVLKYFDHLFPIAPGTEEGTPQEVYKRQHYRLQFWRDGVINFRRFFSVNTLAGIRQEDPLVFEHTHRLLRELVAEDLIDGVRVDHPDGLSDPFGYLHRLRDLIGPDRWLIIEKILSVDEPLDPRLAVDGTTGYDALRELDGVFISRESEDKFSMLALTHSGSTWDERALKSTEESLKRVVAQQELAAEILRLARAMRRDNFSTAGTNVTEDKLSETIIELVAAMPVYRADYISLSRTTATVIAEMSKRFPSRRDALDLIAAALLGNGEAKIRFAQVCGAVMAKGVEDTTFYRASRLVALQEVGGAPGRFGVSAAEFHLLQEERSLLWPRTMTTLSTHDTKRGEDTRARIISLSEVPDMYSELVNRVFAVLPAPDGATGSFLLQNLLGVWPADGVITDALRDRFREYALKAIREASTKTTWVDPNESFEAAVCDWVEALFDGPSTSLITEFVSHINRGSVQISLGRKLLQMVGAGIPDTYQGTEFLEDSLVDPDNRRFVDYTAREQVLERLQTWDWTQVNSVEDLVDNADIAKMAVVHKSLELRAEFRASFVGGDHQAVFGEGRAESHIMGIARGTDRNHLNIIALATRRPLILEDRGGWYDTTVTLPGGQWEDRLTGQRFSGVVPATDLFSHLPVSLLVLVPDSEF

SEQ ID NO: 5818 - protein, 341 aa, Corynebacterium glutamicum
MSDNTLSQFGSYYHEFRRAHPMADVEFLLAIEELLTDGGVTFDRVTTRIKEWSSLKAKARKRRNDGSLIYPDPRKDIHDMIGVRITTYHSTEIPVALKVLQDSFIVHKSVDKAAETRISGGFGYGSHHLILEVDDTSDDLQDYKGLVFEVQVRTVLQHAWAEFEHDIRYKRADVSNPEDFSAEVDRMFTLAAGLIELADQQFDQIAALKETSRVADESVELTAETLPGVLAMLIGNRFPRPRSTNYRFLEDILVANSITSVVQLRELLNPTDIEVLLKVMNYRFHPGQIRIIDDLLLKRFGQSHIDATVATDSQPLNAKRHRQLKRKLELMTQAHLVEPPN

SEQ ID NO: 5819 - protein, 133 aa, Corynebacterium glutamicum
MKSIGMWKFMKTQYVCTTYFIAAPEDEDEAYQTYRSRMNSLAALNGADVVSVADGLRMEVDQDIWGSLAEQYQIEQEGLYPTGHNLYFVVTVVNLDDSDEVYDRTMEHLIMDDPYVRVDRFPSTVHASTQIML

SEQ ID NO: 5820 - protein, 66 aa, Corynebacterium glutamicum
MAGGGNESIFMVVNATTDTDPDLWEVGRQDSREFTIRGRWLRMEHRTDTASHNIARSSGIYNQWTR

SEQ ID NO: 5821 - protein, 63 aa, Corynebacterium glutamicum
MATADEYRFTLGYSAHETRSSSHRFALAAITTFEVMGRAVSSRWAIQRELEGYGVQSSTVISP

SEQ ID NO: 5822 - protein, 352 aa, Corynebacterium glutamicum
MPKVGAVKAANDMVWGPRGRNFLMNLAVAFDDGSVEGSGLRPLEHASWWLDREAEYNTRRRGIAPQYTVLARAKKVAPLLEQVPLIELTPKLMYDALDSTVTNAAYWQPLTNTDLLLATRPMRPGLRRIALHLQRSPLLKSWAEQFRPGGQSSVSWKATGSNHRPSSVHEVLNTWRVEEMNPSLWWSTPPQTLIRTSGKLEDRIPGSLRFVEDGFGWNTGQIRQATILPEAQVFTINGPDDWASLCRRFPLDLPMSNAPNWTMATGYPHKWVIPDYVQVAKHYDGVHLNIQGYLATAGRVVVTDGNRAGILAGWDPGQTYWLTDVVELGEPVTWRNHSQTQEDQDWRPLKMH

SEQ ID NO: 5823 - protein, 348 aa, Corynebacterium glutamicum
MKNVSFGLDTFGDNAIDLQGNPVSPAQTLRNIIDEAKMADKVGVDIIGIGEHHREEYSVSAPDIVMTAILASTERLKVTSSVTVLSSDDPVRLFERYSTMNALSNGRAEITLGRGSFIESFPLFGFDLQDYEQLFSERLDLFAKILEADSRGQGVTWHGETRSALENQMLYPPTENGIHAWVAVGGSPESVVRAAKYRFPLMLAIIGGAPERFRPYVDLYKRANEQFGQPQKPIGVHSPGLIAATDEEARELALNDWLELQRKIGAERGWAPADAMQFEREIDHGSLYIGSPETVAKKIAKTISVLDLDRFTLKYASGQTPHEYLLKSIELYGTEVIPLVKDILTKQA

SEQ ID NO: 5824 - protein, 126 aa, Corynebacterium glutamicum
MSDTDGLPVRIDAWVWAVRLYKTRSEAAEACRAGHVKLNNNAVKPAQQVVPGDRVRVWVNHREFDVEVLRTIKKRVGASVARTCYVDHTPPPPPMEVLASIPRRDRGAGRPTKKERREMEQFRGMS

SEQ ID NO: 5825 - protein, 77 aa, Corynebacterium glutamicum
MSMQPYPRNPIEKRKQEVRKNSRNAVVSVGGGIVGGAALWLVFGSAFFMGLGLIIAVVGGFYYYNKVQKIINEKDRY

SEQ ID NO: 5826 - protein, 595 aa, Corynebacterium glutamicum
MCHSISHLSSPTGSIFTSLVAMLTSQSFSVWAPLPHDVHLILNGETLPMHKTEGSWWRAEIAPKAGDRYGFSLFDGSSWSKTLPDPRSTSQPDGVHGLSEVSDDSYLWGDQQWTGRILPGSVLYELHVGTFSEDGTFEGVVDKLPYLRDLGVTAIELLPVQPFGGNRNWGYDGVLWHAVHAGYGGPAGLKKLIDASHQAGIAVYLDVVYNHFGPDGNYNGQFGPYTSGGSTGWGDVVNINGHDSDEVRNYILDAARQWFEDFHVDGLRLDAVHSLDDRGAYSLLAQLTMVAEDVSAQTGIPRSLIAESELNDPKFVTSREAGGFGLDAQWVDDIHHALHALVSGERNGYYSDFGSVDTLAKTLREVFEHTGNYSTYRGRNHGRPVHPDITPASRFVTYTTTHDQTGNRAIGDRPSTTLTPEQQVLKAAIIYSSPYTPMLFMGEEFGATTPFAFFCSHTDPELNRLTSEGRKREFARLGWNADDIPSPELESTFTSSKLDWEFTAEQRRINDAYKQLLHLRHTLGFSQPNLLTLEVEHGENWLSMANGRGRILANFSDDTITVPLGGELIYSFTSPTVTDTSTTLQPWGFAILTRN

SEQ ID NO: 5827 - protein, 217 aa, Corynebacterium glutamicum
MAHLTQYQLPQAGQVFEHELEIKRSRFLTYITRVQDQEQAREFIHSIKELYPDARHHCSAFIFHVDGSNDVERSSDDGEPSGTAGKPMLEALRGSGMKDIAAVVVRYFGGVKLGTGGLVNAYTNAVTELLPEVLQVTRSVREIFKIDLPHSDAGRIEANLRGMGIIITDTEYGAEVTYTLALLPGEQAAVESQLSSMMGAEIELKESGHMWVESPSD

SEQ ID NO: 5828 - protein, 436 aa, Corynebacterium glutamicum
MSETYVSEKSPGVMASGAELIRAADIQTAQARISSVIAPTPLQYCPRLSEETGAEIYLKREDLQDVRSYKIRGALNSGAQLTQEQRDAGIVAASAGNHAQGVAYVCKSLGVQGRIYVPVQTPKQKRDRIMVHGGEFVSLVVTGNNFDEASAAAHEDAERTGATLIEPFDARNTVIGQGTVAAEILSQLTSMGKSADHVMVPVGGGGLLAGVVSYMADMAPRTAIVGIEPAGAASMQAALHNGGPITLETVDPFVDGAAVKRVGDLNYTIVEKNQGRVHMMSATEGAVCTEMLDLYQNEGIIAEPAGALSIAGLKEMSFAPGSVVVCIISGGNNDVLRYAEIAERSLVHRGLKHYFLVNFPQKPGQLRHFLEDILGPDDDITLFEYLKRNNRETGTALVGIHLSEASGLDSLLERMEESAIDSRRLEPGTPEYEYLT

SEQ ID NO: 5829 - protein, 169 aa, Corynebacterium glutamicum
MSLRRSTLTLVTASAVALSVFTPVAQAQSSDALTQLSDNITSSQILDDDGNPVDGNETWPGSSEGSSMLSNGDIPAAPSLSSSGKDTSDDDDEISEEQQALIDRLSEMPVIGSIVSPPEWLAIPFAVLQGLLAITTLASTAASFMVTVDPSFKQTLRDMLTQFGINVDA

SEQ ID NO: 5830 - protein, 52 aa, Corynebacterium glutamicum
MNTDNATALAVTRVKVLRRKDKTFLLAINMRIYYGNKIEDWIAKAILNSWKV

SEQ ID NO: 5831 - protein, 401 aa, Corynebacterium glutamicum
MSQNRIRTTHVGSLPRTPELLDANIKRSNGEIGEEEFFQILQSSVDDVIKRQVDLGIDILNEGEYGHVTSGAVDFGAWWNYSFTRLGGLTMTDTDRWASQEAVRSTPGNIKLTSFSDRRDRALFSEAYEDPVSGIFTGRASVGNPEFTGPITYIGQEETQTDVDLLKKGMNAAGATDGFVAALSPGSAARLTNKFYDTDEEVVAACADALSQEYKIITDAGLTVQLDAPDLAEAWDQINPEPSVKDYLDWIGTRIDAINSAVKGLPKEQTRLHICWGSWHGPHVTDIPFGDIIGEILRAEVGGFSFEGASPRHAHEWRVWEENKLPEGSVIYPGVVSHSINAVEHPRLVADRIVQFAKLVGPENVIASTDCGLGGRLHSQIAWAKLESLVEGARIASKELF

SEQ ID NO: 5832 - protein, 1194 aa, Corynebacterium glutamicum
MARLSHMAKQSSFVHLHNHTEFSMLDGMAKIDMLADEVKAQGMPAVGITDHGNMYGSNPFYRKMTEMGIKPIIGIETYMAPESRFKKERVRWGEPHQKSDDVSGSGAYLHQTMLAENTTGLRNLFYLSSMASYEGQLGKWPRMDADIIAEHAEGIIATTGCPSGDVQTRLRLGQFDEALEAAAMWQDIYGRDNYFLELMDHGLDIETRVRSELLEIGRKLNLPPLVTNDCHYVLESQAQAHEAMLCVQTGKTLHDEDRFKFGGTGYYVKSAEQMRALWDDMVPDGCDNTLWIAERVQSYDEIWEEHSHDRMPIADVPEGYTPTTWLHHEVMAGLEDRFSGQQVPEDYIERAEYEISVIDMKGYPSYFLIVAEIIKHARSIGIRVGPGRGSAAGALVAYALTITNIDPMEHGLLFERFLNPERPSAPDIDIDFDDRRRGEMIRYAADRWGEDKIAQVITFGTVKTKQALKDSARVQMGQPGYQIADRVIKELPPAIMAKDIPLSGITDPDHPRFNEAGAVRQLIETDPDVKRIYDTARGLEGVVRQSGVHACAVIMSSVPLLDCIPMWKRPADGALITGWDYPACEAIGLLKMDFLGLRNLTVIGDAIENIKANRDGEVLDLENLAIEDEETYKLLGRGETLGVFQLDGGGMQELLKRMQPTGFNDIVAALALYRPGPMGVNAHWDYADRKNGRKPITPIHPELEEALEEILGETYGLIVYQEQIMRISQKVANYTAGQADGFRKAMGKKKPEVLEKEFANFEGGMKANGYSDAAIKTLWDTILPFAGYAFNKSHAAGYGLVSFWTAYLKAHYAPEYMAALLTSVGDNKDKSAIYLSDCRHLGIRVLSPDINESSLNFLPVGTDIRYGLGAIRNVGAEVVDSILDTRKEKGLFKDFSDYLDKIDTLPCNKRITESLIKGGAFDSLGHARKGLMLVFEDAVDSVIATKKAADKGQFDLFAAFDSDNNDDVASFFQITVPDDEWDRKHELALEREMLGLYVSGHPLDGYEDAIAAQVDTALTTIVAGELKHGAEVTVGGIISGVDRRFSKKDGSPWAIVTIEDHNGASVELLVFNKVYSIVGSMIVEDNIILAKAHISIRDDRMSLFCDDLRVPELGPGNGQGLPLRLSMRTDQCTMSNIAKLKQVLVDNKGESDVYLNLIDGDNSTVMILGDHLRVNRSASLMGDLKATMGPGILG

SEQ ID NO: 5833 - protein, 280 aa, Corynebacterium glutamicum
MIFGVLAYLGWGMFPAFFPLLLPAGPFEILAHRILWTAVLMMIIISFTSGWKELKSADRGTWLRIILSSLFIAGNWLIYVIAVNSGQVTEAALGYFINPLLSVVLGIVFFKEQLRKLQISAVVIAAAGVLVLTFLGDKPPYLAITLAFTFGIYGALKKQVKMSAASSLCAETLVLLPIAVIYLIGLEASGHSTFFNNGSGHMALLICSGLVTAVPLLMFALAAKAIPLSTVGMLQYLTPTMQMLWALFVVNESVEPMRWFGFVFIWIAVTIYITDSLLKK

SEQ ID NO: 5834 - protein, 156 aa, Corynebacterium glutamicum
MNKSSFRRAFYIIICSISLYSCASFPVDSEGTLDRARGDELVVGISENKPWTQTSGTGRYSGIEVDLIEGFADTIDADVQWLHAPESVLAEKIKNGQLDLMIGGLSSSSPWSSHMALSRPYHQFDGEEKVMGVRLGENDLMMALERYLAHEFGEIR

SEQ ID NO: 5835 - protein, 306 aa, Corynebacterium glutamicum
MLRKAIKLEWATIAWVLFSIVLVGVVAGQSQAMRSAWIEDMLSLVPPIAFLLASRISKAVATRKHPYGKHRSIAIGHQAAALALLIMGSLLIYEAVSALIKGERPPIGLAILFGHDVWSGWLMIGVMISVSIPMVIVGRVKINLAKDLHDKLLYADADMAKADWGTAVASTVGVLGIGLGFWWADAVAALVISASILRDGVINMKAAISDLGDGRAMTYDNSAPHPLNDDVEKAALEMHWVKHARARIRDQGRCFHTELFVEPVEGYTPAPEEITSLVKRIQNLDWKLQDVVASVVEKIDRFQAPS

SEQ ID NO: 5836 - protein, 292 aa, Corynebacterium glutamicum
MLNDPRTLFPKVDPPKQSQPEPGLDIKLSPQADIGLSSYQGSGRLKGRKALITGGDSGIGAAVAIAYAREGADVAIAYLPEEQADADRVLQAIEETGQKAFSFPGDLRDPEYCRSLVQETVNALGGLDILVNNASRQVWAPGLTEITDENFDQTLQVNLYGSFRVTKAAIPHLKPGSSIIFTSSIQAYQPSETLLDYAMTKAALNNLSKGLASSLIGDGIRVNSVAPGPFWTPLQPSHGQPQEKIEGFGQHAPIGRAGHPVELAGAYVFLASDEASYVVGETLGVTGGTPTP

SEQ ID NO: 5837 - protein, 429 aa, Corynebacterium glutamicum
MEPWAEKLTSDPATCRHLIEEFGSPVNVLHSGSMPRNINELVDAGIQMGVDTRIFFARKANKGLTFVDAVKDTGHGVDVASERELSQVLNRGVPGERIILSAAIKPDRLLALAIENGVIISVDSRDELDRISALVGDRVARVAPRVAPDPAVLPPTRFGERAADWGNRLTEVIPGVDIVGLHVHLHGYAAKDRALALQECCQLVDSLRECGHSPQFIDLGGGVPMSYIESEEDWIRYQSAKSATSAGYAESFTWKDDPLSNTYPFYQTPVRGNWLKDVLSKGVAQMLIDRGLRLHLEPGRSLLDGCGVTLAEVAFVKTRSDGLPLVGLAMNRTQCRTTSDDFLIDPLHITDGDVGEEIEAYLVGAYCIEDELILRRRIRFPRGVKPGDIIGIPNTAGYFMHILESASHQIPLAKNVVWPEGQLDDIDAD

SEQ ID NO: 5838 - protein, 317 aa, Corynebacterium glutamicum
MNRDSFQSIDELIGKTPLVRLGRFNANTSINLWAKMESYNPGGSAKDRTAHAMVLASDLRPGDTVVESSSGNLGIALSREAVLGGWTFHCVVDSRANRNTIAHMKALGTIVHEITEPDYETGDWLVARRKRVAQLRAQMSEAICLDQYSNTAAFQAHEQGTMTEIVEQLGGAPDYLLVAVSTTGTIGGCLGYVAAHGLSTQVIAVDAVGSVLFDGNAGPRHLPGFGAGMVPELSKHLSPHRVFRIDDRTSVEAARKMAQTEAILPGASGGAVLAAMEILRPDIPAGSNVVVILHDDGNKYLDTIYNDEWVEENLCSR

SEQ ID NO: 5839 - protein, 193 aa, Corynebacterium glutamicum
MDGVDKGRRIVALLAILALVVVVAILSFSDRTAKPMQLNGDMLGQDNTETSVEYRQRASESLENAAVGEEAYSLVTFTQPLSPSEASNLLKGVGRVNAMVMLSAPAMDLPEPIAGETREDVFNRQIKLVDAQLSGIGNVRAPGELNGVVVWDIPQKVRVLSESSLVYSVETLPPDAAWGSFGIRPVDTSGTNF

SEQ ID NO: 5840 - protein, 310 aa, Corynebacterium glutamicum
MNNRQSRTLPVPEGLAGMRVDAALSKLLGISRTVAAELATAGDVSVDGAVVGKSERLVADSMLDVLLPEPAAPLMPKEEIVPGLDILYSDDDVIAVNKPVGVAAHPTVGWEGPTVVGGLAAAGFRISTSGPPERKGIVQRLDVGTSGVMVVAASERGYTVLKRAFRDRTVDKTYHALVQGHPDPLTGTIEAPIGRHPSAGWRFAVTTEGKHAVTHYETLEAFQEATLLKIHLETGRTHQIRVHFSALHHPCCGDPMYGSDPALSERLGLNRQWLHAVSLGFNHPADGRWMEIVSPYPTDLQHALDVLREQ

SEQ ID NO: 5841 - protein, 178 aa, Corynebacterium glutamicum
MSKKEKRTTVKQVVALMAAIVVVIASLDQIVKQIMLSWLEPGVPVPIIGDWFRFYLLFNPGAAFSMGGENSTWIFTTIQLSFVIGIAIYAPRIKHKWIAAGLALVAGGALGNVLDRLFRDPSFFFGHVVDYISVGNFAVFNIADASISCGVVVFLIGMFLEDRENAQHAKATDEKDEA

SEQ ID NO: 5842 - protein, 334 aa, Corynebacterium glutamicum
MLKRFSHHSSPQVLSRKVVASALALTTALALAACSSSAEPDSPEVEQAVGLAVDTPRVVVVDPGTGDLQRLQYKDIAPDATQEQTINIAEGFAQSVVNADSVDPQAPAGGDVTTFHLPVKATTEEAEFSDQEMVSATRDISLLFGKPTYTDLSQVEDVNSTEGFTLGIRATDSGQHTTLSFAAPVDSTETGRMLMEQYLLTFTSLPIVFPSDDIGVGAKWTVDSRVTGESTLLQTVTYTITGIDGDKVNLDVEVSQRPSMGALEITDEESDETTGQLTVLNSNTTSVGTLEVDLTQPLPTSGQVSWTTRVIYGGSNEQVRVVQDSTSSVSFGDQ

SEQ ID NO: 5843 - protein, 550 aa, Corynebacterium glutamicum
MRTFAAYIAIDGLSFSYPNTHVLSDISLTVANGDIAGLIGENGAGKSTLLSLIAGVMEPDQGRIYLPERTGFIAQETDLPFEQPVQSLIDAAVAPVRAVDAAITDLSTKLGDASLSAEEQAQVATDFDAALGAAEELGLWELDARIETIVAGLGLAEVDRSTPIGELSGGQRRRFALAALLLEPHDALIFDEPTNHLDDTAVDFLISEISRFKGPVLIASHDRFFLDSVCTELIDLDPALGPEGGSGEEVKQAVSFGGGFSEYIKERETRRTRWAQLYTAQETEREKLEETTGTTESDIFHSSVSKSEAKITAKFYADRAAKTQGNRVRSAKNRLKELERYEIPAPPKPLEFQGIPEASGNGHGETLEVRAIAVENRLQPLTFHIDPGDHILVEGPNGVGKSTLLSVLEGVLEPTEGELIVPEGLKVARLKQDDQWTEKQLNTPVDELFAALSKGPVGLNLVEMGLLRETSQSSPLRALSLGQRRRVSLGLILASPPDLLLLDEPTNHLSLALSEELESAIEKFPGRVILASHDRWIRKRWTGKKISLSR

SEQ ID NO: 5844 - protein, 101 aa, Corynebacterium glutamicum
MEEEVLDSEEESSLLEHALSANAAATVKVTAVALKSFTMKMILCSNLWSPNIYQHSTATHSMEPTMDDLVPHPHTKCTQFRLSAQFRRAPSACDLGVRRFQ

SEQ ID NO: 5845 - protein, 200 aa, Corynebacterium glutamicum
MKLFKATAVTFTVAAALALSACSSSDDSSSESSTSSSTSSAASDAATQYPTAEELNAILAVATDPEAPIEEKVKTVQGSENAPELFETMTQAKVESGAEFQVVGSVLPGYDPTSEVLTTVMFQLPDRAEQEAEGVEFVNTDGNWQLSQDWACILITNTVAPEQVPAMCVGTDASSAGIEEAPAEEGAVVEEAPVEEVPVQ

SEQ ID NO: 5846 - protein, 325 aa, Corynebacterium glutamicum
MSKQHSTPLNNDEEHTSAPQKVAVITTGGTIACTSDANGHLLPTVSGADLLAPIAPRFNGAQIAFEIHEINRLDSSSMTFEDLDSIIATVHKVLEDPDVVGVVVTHGTDSMEESAIAVDTFLDDPRPVIFTGAQKPFDHPEADGPNNLFEACLIASDPSARGIGALIVFGHAVIPARGCVKWHTSDELAFATNGPEEPERPDALPVAKLADVSVEIIPAYPGATGAMVEAAIAAGAQGLVVEAMGSGNVGSRMGDALGKALDAGIPVVMSTRVPRGEVSGVYGGAGGGATLAAKGAVGSRYFRAGQARILLAIAIATGAHPVTLY

SEQ ID NO: 5847 - protein, 467 aa, Corynebacterium glutamicum
MQRWVLHIDMDAFFASCEQLTRPTLRGRPVLVGGVSGRGVVAGASYEARKFGARSAMPMHQAKARVGFGAVVVTPRHIVYSAASRRVFQIVEKRAGIVERLSIDEGFMEPEALVGATPEEVKQWAEELRAEIKEVTGLPSSVGAGSGKQIAKIGSGEAKPDGVFVVPVDKQHDLLDPLPVGALWGVGPVTGSKLASMGVETIGDLAALTQKEVEISLGATIGISLWNLARGIDDRPVEPRAEAKQISQEHTYEKDLLTRQQVDAAIIRSAEGAHRRLLKDGRGARTVSVKLRMADFRIESRSYTLSYATDDYATLEATAFRLARYPGEVGPIRLVGVSFSGLEESRQDILFPELDQQIIVPPAPDTDYEVGVQSSSSSESTQVEAPQDVALSMWCATQDVYHPEYGHGWVQGAGHGVVSVRFETRSTTKGRTKSFSMDDPDLTPADPLDSLDWADWFAENGETGDDE

SEQ ID NO: 5848 - protein, 286 aa, Corynebacterium glutamicum
MNDAGLKTRNPVLAPILMVVNGVSLYAGAALAVGLFESFPPALVAWMRVAAAAVILLVLYRPAVRNFIGQTGFYAAVYGVSTLAMNITFYEAIARIPMGTAVAIEFLGPIAVAALGSKTLRDWAALVLAGIGVIIISGAQWSANSVGVMFALAAALLWAAYIIAGNRIAGDASSSRTGMAVGFTWASVLSLPLAIWWWPGLGATELTLIEVIGLALGLGVLSAVIPYGLDQIVLRMAGRSYFALLLAILPISAALMGALALGQMLSVAELVGIVLVVIAVALRRPS

SEQ ID NO: 5849 - protein, 334 aa, Corynebacterium glutamicum
MLIGEVSKLSGVSARMLRHYEKLGLVEPKQSTAGYREYSEGDVRRIFHIEGLRSLGLSLKQVGDALEDPDFDPQAVISEMIAETSARISMERELLARLKAVRHAQASDWESALDAVQILRRLRSGDPAQRQAVAYDSVSGKEAVALETLVESALGESHLNAEGALSWAVVQRGEEAVALAARGLRSRDAAVRLRAVRIVASAPSAVADRVEWLRPMIRDPDALVRAETALALGKSGDESAVEQLVSMVLTGLRDVEAAELLAGFGEPVQLDVFKKFARTLDDEETMSPTRGRIAQALAEFNLAPVAFLVEQLVDDDNPTVAFTAAAIIKAKGLK

SEQ ID NO: 5850 - protein, 44 aa, Corynebacterium glutamicum
MKSESGSAMSLAVATACALVKAPRSTLIDASLPSNSAIARLKLR

SEQ ID NO: 5851 - protein, 209 aa, Corynebacterium glutamicum
MNISAMDNFEHSNASIRLQAALAAGTAEDTTAIDILLYRSGVEEDFFVRDMITWALTRMPVDDVFTSLVADLDSEVPDRPFGASQALHTLSKLRVAQSWQELQARPWLLHREDTAQTAWRTFVGLVPDDQTAWLAHQLLQELDKGTPEIQRSLSRAMAELEGREASISVLLGALTSAHAVATAKLIADPDSDFMADLEEARRVDNMGAC

SEQ ID NO: 5852 - protein, 1054 aa, Corynebacterium glutamicum
MSEAVGGVYPQVDLSGGSSRFPEMEENVLSYWKKDDTFQASIDQRDGAEDYVFYDGPPFANGLPHYGHLLTGYVKDIVPRYQTMRGYRVPRVFGWDTHGLPAELEAEKQLGIKDKGEIEAMGLAKFNEYCATSVLQYTKEWEEYVTRQARWVDFENGYKTMDLSFMESVIWAFKELYDKGLIYQGFRVLPYSWAEHTPLSNQETRLDDSYKLRQDPTLTVTFPVTGVVEGSSANAGLVGALALAWTTTPWTLPSNLALAVNPAVTYALVEVAEDGEAEFVGKRVLLAKDLVGSYAKELGAEAVIVSEHPGSELVGLTYEPIFGYFRDHANGFQILGAEYVTTEDGTGIVHQAPAFGEDDMNTCNAAGIEPVIPVDIDGKFTGLVPEYQGQLVFDANKDIIKDLKAAGRVVRHQTIEHSYPHSWRSGEPLIYMALPSWFVNVTEIRDRMVEVNQDIEWMPAHIRDGQFGKWLEGARDWNISRSRYWGSPIPAWVSDNDEYPRVDVYGSLDELEADFGVRPKSLHRPDIDELTRPNPDDPTGKSTMRRVTDVLDVWFDSGSMPFAQVHYPFENKEWFDTHAPADFIVEYIGQTRGWFYLLHVLSTALFDRPAFKKVVAHGIVLGDDGLKMSKSKGNYPNVNEVFDRDGSDAMRWFLMSSPILRGGNLIVTEKGIREGVRQAQLPMWNAYSFLQLYTSKNATWSVDSTDVLDRYILAKLHDLVAETQAALDGTDIAKACDLVRNFCDALTNWYVRRSRDRFWAGDEAHPEAFNTLYTVLETLTRVAAPLLPMTTEVIWRGLTGERSVHLTDFPSAESFPADADLVRTMDEIRGVCSAASSVRKAHKLRNRLPLPGLTVALPDSARLADFASIIRDEVNVKNVDLTSDVDSVGTFEVVVNAKVAGPRLGKDVQRVIKAVKAGNYTREGDVVVADGIELNEGEFTERLVAANPDSTAQIDGVDGLVVLDMEVTEELEAEGWAADAIRGLQDARKNSGFEVSDRISVVVSVPEDKKEWITTHADHIAAEVLATSFEIVTDALDGETHDIVAGVTAKVTKN

SEQ ID NO: 5853 - protein, 72 aa, Corynebacterium glutamicum
MFGFHSNIVHIALQGTVTLVFFAAIILSLVGFILLVITVIEPSHTWTVLLIIVVVAGLICFGIDMWNKRKAH

SEQ ID NO: 5854 - protein, 365 aa, Corynebacterium glutamicum
MPLTPADVHNVAFNKPPIGKRGYNEDEVDQFLDLVEDALVQFQEENEDLKQQVEELEAQVAGGTSSAASSSTAGAATAAASKSVDEAALRKEIEEKLRSEYASKLDDASKAAQKAQNDAKSAQDQLQRAQADAKAARDEAEKAKAEAKSAASSSTTKAAAVGAVGAGTGAAVATGAANVDTHMQAAKVLGLAQEMADRLTSEARSESKSMLDEAREAAEKQIEEANSTSNRTLEDARANAEKQIAEAQNRADTLVNEADAKAKNLVSEAEKKSAATLAASTSRAEAQIRQAEDKANALQADAERKHTETMAAVKEQQNALETRIAELQTFEREYRTRLKSLLEGQLEELNARGSSAPTNNKPSGE

SEQ ID NO: 5855 - protein, 95 aa, Corynebacterium glutamicum
MGNIAILIAWLIGIYTWVLVARIVIEMIQSFSRSFTPPKWFYYIAEPVFMVTDPPVKLLRRVIPPLPLGNVRLDLSVLVLFFILSILRSVVLVLA

SEQ ID NO: 5856 - protein, 152 aa, Corynebacterium glutamicum
MSMLKKTKEFFGLAPYEAEHEDAYYADEPRYEGTAAYAPEYRERDYGYAPEAPAPVAPSPAPRSYQSTIVPVELHSFEDAQVIGGAFRDGDAVVFDMSLLSREEARRIVDFAAGLCFALRGKMQKIDSVTFAVVPELSNISTSELERAARIR

SEQ ID NO: 5857 - protein, 221 aa, Corynebacterium glutamicum
MQARIDATLNEHNRPEGSVRLLPVTKFHPVEDIKILQEFGVTAVGENREQEARAKALELPDMDFHMIGQIQSKKANSIARWAAAVHSVDSEKIAEALGRGVALALDRGDRTSDELPCFIQLSLDGDPSRGGTPLSQVTQLADCISDTTHLRFEGLMCVPPLGWGPEKAFSQARDVLSGLEEHFDRSLEFSAGMSGDLVAAIKHGSTIVRVGTEILGNRPLA

SEQ ID NO: 5858 - protein, 246 aa, Corynebacterium glutamicum
MDSLDPRNRPVRKVFTTRAGGVSQSPYASFNLGDHVGDDPQAVASNRNRLADIIGLSPDKVVYMEQIHSNTVTVIDEAPADGQAVEATDALVTTQRGLALAVLVADCVPVLLSDTDAGVIAAVHAGRMGARNGIVAKTIAKMEELGAKPSRIHALMGAAASGANYEVPEAMARDVEAKLPGSIARTTKGTTGLDIRAGLLRQMLSLGVQMIDSDPRCTIEDEDLFSYRREGTTGRQAGVVWLPKEA

SEQ ID NO: 5859 - protein, 162 aa, Corynebacterium glutamicum
MLSFSGGRVALVVGTCCWTGSAAGAAEMPARRFSAALARAASKPVAMTVTRTSSPRLSSMMVPKMRLTSSSERSRTMDAAALTSMRPRSDPPAKDSRTPVAPSIVASRSGELMACSVAETTRLSPRAEPTPMSAEPASDMTERTSAKSTLITPGMVIRLVIP

SEQ ID NO: 5860 - protein, 442 aa, Corynebacterium glutamicum
MTSPNNYLAKIKVVGVGGGGVNAVNRMIEEGLKGVEFIAVNTDSQALMFSDADVKLDIGREATRGLGAGANPEVGRASAEDHKNEIEETIKGADMVFVTAGEGGGTGTGAAPVVAGIAKKMGALTIGVVTKPFEFEGRRRTRQAEEGIAALKEVCDTLIVIPNDRLLELGDANLSIMEAFRAADEVLHNGVQGITNLITIPGVINVDFADVRSVMSEAGSALMGVGSARGDNRVVSATEQAINSPLLEATMDGATGVLLSFAGGSDLGLMEVNAAASMVRERSDEDVNLIFGTIIDDNLGDEVRVTVIATGFDAARASAAENRRAGISAAPAAEPVQQQVPTTNATLPPEKESIFGGAREENDPYLSRSAGARHRIEETRSGGGLFTTGNDRDYRRDERREDHRDERRDERRDDRSYDRRDDRRDDRRDDRGDDLDVPSFLQ

SEQ ID NO: 5861 - protein, 222 aa, Corynebacterium glutamicum
MNKKVIAIVVGVVVVLVAILGVVAWFVPILKVGNIEVTGATRTDPDQVLEVSGIVEGENLFRVDATAAGQNIVELPWVKSVTVNRALPSTITVELTEREPAVFIKRADGDHVIDTEGKEIIIGTPPVGTVEVSGADEGNSEVLPAVIAVINAIKAQDAQMTESIQVVEAPDQFDILLKMNDGREIYWGSSENNHDKAVAMSTVLKREGQRWNISSPSMVTVR

SEQ ID NO: 5862 - protein, 486 aa, Corynebacterium glutamicum
MTTPHLDSAQDIDLSRVHLIGIGGAGMSGVARILLARGKTVTGSDAKDSRTLLPLRAVGATIAVGHAAENLELSGELPTVVVTSFAAIPQDNPELVRAREEGIPVIRRSDLLGELLEGSTQVLIAGTHGKTSTTSMSVVAMQAAGMDPSFAIGGQLNKAGTNAHHGTGEVFIAEADESDASLLRYKPNVAVVTNVEPDHLDFFKTPEAYFQVFDDFAGRITPNGKLVVCLNDPHAAELGERSVRKGIKTVGYGTADAVQAHPEVPAMATIVDSQVVAEGTRATINIDGQEVSVILQIPGDHMVLNGAAALLAGYLVGGDVDKLVEGLSDFSGVRRRFEFHGAIEGGKFNGAAIYDDYAHHPTEVTAVLSAARTRVKAAGKGRVIVAFQPHLYSRTIEFQKEFAGALSLADAAVVLEIYGAREQPVDGVSSEIITDAMTIPVVYEPNFSAVPERIAEIAGPNDIVLTMGAGSVTMLAPEILDQLQNN

SEQ ID NO: 5863 - protein, 372 aa, Corynebacterium glutamicum
MKSGELRIKMANSPKPMRVVVAGGGTAGHIEPALAVAEALRDKHGATVSALGTARGLETTLVPDRGFELHLIEPVPVPRKPNMDLLKLPFRVAKALGQARKALKDTDAQAVIGFGGYVSAPAYMAAKSLGLPFFVHEANARAGMANKLGVKLGGVGLNAVAGSGMDGDVVGIPIRAVLSGARDESAADRARDTWGLDKDRQTIFVTGGSQGSVSINKAVEQAVDQLVEAGFQVLHAVGKKNELPAAKPGYHPVPFIDDMQAAYTVADLIVCRSGAMTVAEVTAAGVPAIYVPLPHGNGEQALNAQAVIKAGAARQIDDADFTAQTLIDATLDILLHPSTHQSMSDAAKTSTAGNASTVIADMIAATINSQHN

SEQ ID NO: 5864 - protein, 550 aa, Corynebacterium glutamicum
MTTGASKKPARPNTGAKTRTGLGIRERISGAWNDLLARPLTDYIMILCIVVILSCLGVVMVYSSSMTWSLREGGSVWGTAVRQGIMIVLGFFAMWVALMTRPQTIRNLSNLILIVSIVLLLAVQIPGIGTGKEEVGSQSWIALGPIQFQPSEIAKVAIAVWGAHYLAGKGPVQHWFNNHLMRFGGVGAFMAFLIFMEGDAGMAMSFVLVVLFMLFFAGIAMGWIAIAGVLIIAALAVLALGGGFRSSRFEVYFDALFGNFHDVRGIAFQSYQGFLSLADGSGLGVGLGQSRAKWFYLPEAKNDFIFAIIGEELGLWGGALVIALFAGLLYFGLRTAKKSHDPFLGLMAATLTASVVSQAFINIGYVVGLLPVTGIQLPMISAGGTSAIITLASMGLLISCARHEPETVSAMASYGRPAIDRLLGLREPSSTLTTSNASLRSNKTKAAKQKPSPQKESRDRFGEPVTARRAQAPRSGRAGVQSEAPRRSTGSVKGRSSGQDNGRSNEGTARSQSTTGGRAADRSVDRSRQSRPTERRSESRDDWRDNRNRR

SEQ ID NO: 5865 - protein, 156 aa, Corynebacterium glutamicum
MAGHRGQVVAEHDGVHFIDNSKATNPHAADSALAGHDSVIWVVGGQLKGADIAPLVKKHEQRIKAALVLGADRAEIVAALKEHASQASVFVTDKTEPFEAMEEIVTEAFSISEPGDTVLLAPAAASLDMFKGMGQRGDLFAHNIIGTIKGLTEEKG

SEQ ID NO: 5866 - protein, 128 aa, Corynebacterium glutamicum
MSTTPASGVKVGDQCNWKLDSSATNTSMRFFATKASDTGMPILPTALAVKPPSFIIAASIDVVVVLPLVPVTASHVCGSPKTPAWSRRQASSTSPITSRPWRWASTSKVLVGRQPGEVTTMEKESSCS

SEQ ID NO: 5867 - protein, 111 aa, Corynebacterium glutamicum
MWLAENTCLVQAPSKLDVTDNLKALAVGVDKQSACWAPARGGDHNGERIQLFLSLRGADICNVYYFNEHVTCSFVIVGDHNIAMQLTEHLCNGQAGNTSAGHKNTALQRLR

SEQ ID NO: 5868 - protein, 366 aa, Corynebacterium glutamicum
MQQIMVSGTVAFLVSIFLTPVLIRYFTNRQLGQEIREEGLQSHLRKRGTPTMGGIAIIAGIVVAYVFTNILAMIQGVGGFTVSGLLVLGLTLGLGATGFADDFIKLYMNRNLGLNKTAKLVSQLAIALIFGFLVLQFPDENGLTPASTHLSFIRDIDTIDLGFGGSVFGIIVFLIFIYVVVSAWSNAVNITDGLDGLAAGTTAFVMGAYTLITFWQFRNSCDTAVEAGCYTVRDPLDLSVLCAAGLGATLGFLWWNAAPAKIFMGDTGSLALGGLVAGISVVSRTELLMVIIGALFVIEIASVAIQIGVFKTRGKRVFKMAPIHHHFEALGWAETTVTIRFWLIAIMAVLAGVGVFYSDWLHLAEV

SEQ ID NO: 5869 - protein, 514 aa, Corynebacterium glutamicum
MITMTLGEIADIVGGRLTGGAQEDTLVSSSVEFDSRSLTPGGLFLALPGARVDGHDFAATAIEKGAVAVLAAREVDVPAIVVPPVKIQESNADIYAHDPDGHGAAVVEALSRLARHVVDICVAGHQLNVVAITGSAGKTSTKDFIATVLDQDGPTVAPPGSFNNELGLPHTALRCTTDTKYLVAEMSARGIGHIKHLTEIAPPRIAAVLNVGHAHLGEFGSRENIAQAKGEIIEALPSKKTGGVAVLNADDPFVARMAPRTKARVVWFTTDAGQAKKSDYWATSISLDAVARASFTLNTKDGSWPVTLQVFGEHQVANALAAAAIAMEAGVAPELVVAGLEAHSAASAHRMDVKTRADGVTIINDSYNANPDSMRAGIAALAYTASGRSEATSWAVLGQMGELGDDASEAHAELGAELAKYNVQELVAVGENPNCAALAESAASLGVSTHVVSDVDAALELLAGHIKRDDVVLVKASNADRLWRVAEALHGMVPGLKNTGGSVNDDSRRNVEGQ

SEQ ID NO: 5870 - protein, 517 aa, Corynebacterium glutamicum
MLDLTKLIDGILKGSAQGVPAHAVGEQAIAAIGLDSSSLPTSDAIFAAVPGTRTHGAQFAGTDNAAKAVAILTDAAGLEVLNEAGETRPVIVVDDVRAVLGAASSSIYGDPSKDFTLIGVTGTSGKTTTSYLLEKGLMEAGHKVGLIGTTGTRIDGEEVPTKLTTPEAPTLQALFARMRDHGVTHVVMEVSSHALSLGRVAGSHFDVAAFTNLSQDHLDFHPTMDDYFDAKALFFRADSPLVADKQVVCVDDSWGQRMASVAADVQTVSTLGQEADFSATDINVSDSGAQSFKINAPSNQSYQVELALPGAFNVANATLAFAAAARVGVDGEAFARGMSKVAVPGRMERIDEGQDFLAVVDYAHKPAAVAAVLDTLRTQIDGRLGVVIGAGGDRDSTKRGPMGQLSAQRADLVIVTDDNPRSEVPATIRAAVTAGAQQGASESERPVEVLEIGDRAEAIRVLVEWAQPGDGIVVAGKGHEVGQLVAGVTHHFDDREEVRAALTEKLNNKLPLTTEEG

SEQ ID NO: 5871 - protein, 75 aa, Corynebacterium glutamicum
MSFVEFHNLNFCLNSFRHHPRAASELLTPRNLWRRENHGNHVAGPHQTYRWHPQGLCPGRSRSRSRGTSNRGYWS

SEQ ID NO: 5872 - protein, 651 aa, Corynebacterium glutamicum
MTYRPKSSTQGGARKRRVNMVTAIALVIAGVLIIRLGWVQVVWGPELSLNASEQRTRVYVDPARRGSIVDREGNQMAYTMQARSLTVSPNIMREELKTGTDLALRLAAEETDPENVASYVTIEEGNAYVFASEEQRETILSDKVEERIQSIADRIPEIIKSHDQDVTGISSEEILDKLNADSQYEVLVRNVDPDVASEITDEMPSVAADHQDIRQYPNGAIGENIIGRISMDGEGQFGFEASNDSLLAGNNGRSTQDMSILGQAIPGTLRDQIPAIDGASVELTVDLDLQTYVQQALEQAKANSGAENASAVVLDAKTAEVLAMANTDTINPNEDTGKQIEQGKSFDNPSVTHPFEPGSVAKVITAAGVIQEGLTTPDEVLQVPGSIEMAGVSVGDAWDHGVVPYTTAGIFGKSSNVGTLMLAQRLGEDKFADYLERFGVGQPTGIELPSESQGLLPAREQWSGGTFANLPIGQGMSITTLQMAGIYQALANDGERIQPRIIKSVTDSDGTVLEQPEPDKIQVVSAEAARTTVDMFRSVTQVDPTGVQQGTAPDASIEGYQISGKTGTAQKVDPNTGAYSNSQYWITFAGIAPADDPRFVVAIMLDEPERGVHGGGGQTAAPLFKDIATWLLNRDNIPLSAATEPIILQAQ

SEQ ID NO: 5873 - protein, 265 aa, Corynebacterium glutamicum
MTMTNGSRTESGKIRDRRVADADPRYGRRVSVSRDFSTAEASGRGASISTQPRRDMAPERRHTTRALVNPGVQPTRKRLMQHKLGSQQVMSVRGRRVEAKRADPKVIQLSVLVVILLCVGVGATMGLSGTSTQQTFQLQELQATETDLSNRIESLNRDVEDARSAATLAANATEMGLVSPVEPGVLAVQENGDVVEEREANPETRPIVDINGQQTRPNRASSNPDETNAVTENLQAIPQEAAAPPYQTNTVPYAATTGQAGGAGQ

SEQ ID NO: 5874 - protein, 337 aa, Corynebacterium glutamicum
MEDFSLDGNHGHVPVMRDRMAALIAEHVEALGENAVIVDATLGAGGHAEFFLNTFPKARLIGLDRDQNALRDARARLAPFGERFIGVQTRFDGLREVLESVEGDIIDLAREHGIAGALFDLGVSSMQLDQVERGFAYRTDAPLDMRMDATQGITAADILNTYSHGDIARILKTYGDERFAGKIASAVLKEREKEPFTTSARLVELLYDAIPAATRRTGGHPAKRTFQALRVEVNNELDSLKNVLPQITDALNVGGRAVFMSYQSHEDKLVKKFFTDLTTSKTPPGLPVDLPGTAPQFKQVTRGAETASEAEIEENPRAAPVKVRAIERIGNNSGDLS

SEQ ID NO: 5875 - protein, 143 aa, Corynebacterium glutamicum
MFLGTYTPKLDDKGRLTLPAKFREDLAGGLMVTKGQDHSLAVYPKEEFAARARKAAAVSRTNPEARAFIRNLAASADEQRPDGQGRITLSAAHRTYAGLTKECVVIGSVDFLEIWDAQAWAAYQEETEAAFSAAEDDVLGGLL

SEQ ID NO: 5876 - protein, 129 aa, Corynebacterium glutamicum
MSLSEQEQRALREIEQALMADDPKFGKAVASNNGLAGGGFTLRGIALFVLGLVLLVAGVALSQQTLWFVALGIIGFLVMFGSGVWMLRGGRLQQNLRHIPHFQCEESPTGQFHHWGQNGRKLPSTIRGQ

SEQ ID NO: 5877 - protein, 141 aa, Corynebacterium glutamicum
MGDVISATTRFERVGGKRAQFFSKAHILLEQAHTYRGEGDLLLALEMSYQSALRTAGAVVAGSDVAARKRKPKSAWDQLQLVGDEAAEWAAELSQFSTIRSRASSGLDITLSAADLDRFMARVALFLEEAQHGFSPSVDAA

SEQ ID NO: 5878 - protein, 191 aa, Corynebacterium glutamicum
MMGSVSPIIRKLSIPEFTTNTPVLVDIYIAAMNYDKAIRDTRIEVWRRNSQNPGFTAVAALMDDQVVGVAYGFNGSPDHWWQHQLRRGLRQQGGPTEEEIHIIHNYFEVAEVHVQPGFQGHGIGRKLMHELLKDKQNTFAILSTPEVDDEANHAFSLYRSLGFTDLLRQFRFDGDQRPFAVLITALPLHDS

SEQ ID NO: 5879 - protein, 326 aa, Corynebacterium glutamicum
MSLTNIPASSQWAISDVLKRPSPGRVPFSVEFMPPRDDAAEERLYRAAEVFHDLGASFVSVTYGAGGSTRERTSRIARRLAKQPLTTLVHLTLVNHTREEMKAILREYLELGLTNLLALRGDPPGDPLGDWVSTDGGLNYASELIDLIKSTPEFREFDLGIASFPEGHFRAKTLEEDTKYTLAKLRGGAEYSITQMFFDVEDYLRLRDRLVAADPIHGAKPIIPGIMPITSLRSVRRQVELSGAQLPSQLEESLVRAANGNEEANKDEIRKVGIEYSTNMAERLIAEGAEDLHFMTLNFTRATQEVLYNLGMAPAWGAEHGQDAVR

SEQ ID NO: 5880 - protein, 371 aa, Corynebacterium glutamicum
MKDVSLSSFDAHDLDLDKFPEVVRDRLTQFLDAQELTIADIGAPVTDAVAHLRSFVLNGGKRIRPLYAWAGFLAAQGHKNSSEKLESVLDAAASLEFIQACALIHDDIIDSSDTRRGAPTVHRAVEADHRANNFEGDPEHFGVSVSILAGDMALVWAEDMLQDSGLSAEALARTRDAWRGMRTEVIGGQLLDIYLESHANESVELADSVNRFKTAAYTIARPLHLGASIAGGSPQLIDALLHYGHDIGIAFQLRDDLLGVFGDPAITGKPAGDDIREGKRTVLLALALQRADKQSPEAATAIRAGVGKVTSPEDIAVITEHIRATGAEEEVEQRISQLTESGLAHLDDVDIPDEVRAQLRALAIRSTERRM

SEQ ID NO: 5881 - protein, 490 aa, Corynebacterium glutamicum
MLLLGSFGGGAIRYRGGVLDALGLNFLAFGHAQGISNTVLWVGQLLLIGAWVHLGRRLFKKKVADDTADAADLGLVKRTLYAMVVPLIFAAPMMSRDVYSYLMQGAMLRDGFDPYTEGAAVNPGPMLLEVSHDWRNTTTPYGPLHLWIGDMITTVVGDNVTLGVVAYKILSIIGLAVTGWSIVRIAQHFGANPAIALWIGVANPVMIIHMIGGMHNESLMVGLVSVGLLLALKKRFVAGVALIAVAVSLKATAAIALPFVVWIGMHHFAGFLATKKGKDSPTLKQQVPAFFATGAAGVAVTGVVVSAITWASGASWGWISEISGNSKVINPLAFPSLVASVITMVAEVFVDDFDYNAVVNVVRSISMLIMLGGLVVCWWLFRQNERRAVTGTAAAYAVAFVFNSVTLPWYYASLISLLGTFKPPMWLIRFAAGASVFIALMFTGSGNHQLYNIVTVIIAAIIAWLATVVIFDDTDPATTATEKPSPHTVS

SEQ ID NO: 5882 - protein, 169 aa, Corynebacterium glutamicum
MHKVNRHPTNKMGWRFFRSFRKRLERHCLSASHNFTSQLAMKCIDGATRKGLVFGKQEREDFLVAEATVGKQGNNSRDETVGVFLLGAQESFWNVANTVAPDHDQFVFIDQIHHLGDNNAEALGCLRKGQQWFIVGQGEGRFIVGTHSLNLAGSSSNGESLGYFCACRE

SEQ ID NO: 5883 - protein, 123 aa, Corynebacterium glutamicum
MSSNNESSFALPDNEPLLTLPETAERLGVVVTKVMDLVNEHKLIVVRRDGIRYIPEAFLSTKKENTNRFIPGVIALLADGGFSDEEILAFLFTEDETLPGRPIDALHGQLAREVMRRAQAMAF

SEQ ID NO: 5884 - protein, 716 aa, Corynebacterium glutamicum
MSTVYRCLDLRLGRSMALKVMEEDFVDDPIFRQRFRREARSMAQLNHPNLVNVYDFSATDGLVYLVMELITGGTLRELLAERGPMPPHAAVGVMRGVLTGLAAAHRAGMVHRDIKPDNVLINSDHQVKLSDFGLVRAAHAGQSQDNQIVGTVAYLSPEQVEGGEIGPASDVYSAGIVLFELLTGTTPFSGEDDLDHAYARLTEVVPAPSSLIDGVPSLIDELVATATSINPEDRFDDSGEFLSALEDVATELSLPAFRVPVPVNSAANRANAQVPDAQPTDMFTTHIPKTPEPDHTAIIPVASANETSILPAQNMAQNMAQNPLQPPEPDFAPEPPPDTALNIQDQELARADEPEINTVSNRSKLKLTLWSIFVVAVIAAVAVGGWWFGSGRYGEIPQVLGMDEVQAVAVVEEAGFVAVAEPQYDNEVPTGSIIGTEPSFGERLPRGEDVSVLVSQGRPVVPDLSEDRSLSTVREELEQRTFVWVDGPGEYSDDVPEGQVVSFTPSSGTQLDVGETVQIHLSRGPAPVEIPDVSGMGVDQATRVLERAGLSVERTEEGFDAETPNGDVYGTSPKVSTEVKRGTSVVLQVSNAISVPDVVGMTKDEATAALAEEGLVVASTSIIPGEAASSADAVVTVEPESGSRVDPAHPQVSLGLAGEIQVPSVVGRKVSDARSILEEAGLTLTTDADDNDRIYSQTPRARSEVSVGGEVTVRAF

SEQ ID NO: 5885 - protein, 217 aa, Corynebacterium glutamicum
MGGKHISWLSIRDLGISPIGCGINRHRDPESRQAQLCCDIFQCGQKLSRIIETILRINGGSCRDKLIDEGGDAVDKRTRCRHDFRKAGVCMVEIILARKRRGACEQLKEHNACRIHVAGRPDLTALNLLRGKISHRAHNLIVLRLAGVSRSNQAEIRQFHLVITIDQHVVRLDIPVHHARPVGSRETREHPTHNAHSSMRGHRSPLSQQLTQGATSD

SEQ ID NO: 5886 - protein, 412 aa, Corynebacterium glutamicum
MVPSLQQWRKPALILAILTVLGVLLTHWFAWPLTWPLGLRLPVDVEVYWQGAREFWLADDLYDIRYDTTFDNLPFTYPPFGALVFTPLWWIHDLFGLLVTERVFALITLLTTYAVAVFLLRLAGVRDRVWEFVAFAALLVSAPVYFTLNIGQINVMLMALTLFDVALPRSTRHSGVLKYVPLGVLTGIAAAIKLTPLVFGLYFLILWVVTKSPRGLFGMIGGFLGASGLAIIFRPSISIQYFTDVLFTAERIGDLHFARNVSIRAVLERLPELGSAASIMWLVAVALVIIAVAVAAYRILRTDLSAHNRLLAVSLVSLVALLCSPVSWYHHWVWLGPLIVALWLTQHRWLALWGAFAVTFGSFHNFLPSENNMELTWPWWMHVLAAHYLIFSAVVTAVFSCGKMPQKTELSH

SEQ ID NO: 5887 - protein, 436 aa, Corynebacterium glutamicum
MTNPQTAHAAASDSASQKEAPNPSLSITVGIKDLLGLLSVLGIAAGLIANKILIERYNWRIDAAVYREGALALVNGESLYAQPFDMGDISLPFIYPPIGAILFAPWGYFDFITVELAGNLVVIGSSLLLLLCLYLVTNAVLSGRDKLLAFTIAAISWPIALFAEPVFLNADLGQINILIMALVVMDLLPIKRRIPRGVLIGLAAAIKITPLAMLLYFLVKKDFRGIINAVISLLAFTAIGAVLAWENTKEFFSSTLLNLSAEGDSGVDTTFQSNSSIQAMLYRWWTSKADAEASSLPTILWIVLSLIAVAAVAYLMHQLFSRGLHVEAVMVNAMLMLLISPISWSHHWVWLPLWAVVFFVRYRQHRSHPKFLLWSGVILSVMLLMLPPKWWFGRDGVNVFELNFWEKLLISDWTWLSIGLMITLGLGLKAFPKISK

SEQ ID NO: 5888 - protein, 462 aa, Corynebacterium glutamicum
MSWTVDIPKEVLPDLPPLPEGMQQQFEDTISRDAKQQPTWDRAQAENVRKILESVPPIVVAPEVLELKQKLADVANGKAFLLQGGDCAETFESNTEPHIRANVKTLLQMAVVLTYGASTPVIKMARIAGQYAKPRSSDLDGNGLPNYRGDIVNGVEATPEARRHDPARMIRAYANASAAMNLVRALTSSGTADLYRLSEWNREFVANSPAGARYEALAREIDSGLRFMEACGVSDESLRAADIYCSHEALLVDYERSMLRLATDEEGNEELYDLSAHQLWIGERTRGMDDFHVNFASMISNPIGIKIGPGITPEEAVAYADKLDPNFEPGRLTIVARMGHDKVRSVLPGVIQAVEASGHKVIWQSDPMHGNTFTASNGYKTRHFDKVIDEVQGFFEVHRALGTHPGGIHIEFTGEDVTECLGGAEDITDVDLPGRYESACDPRLNTQQSLELAFLVAEMLRN

SEQ ID NO: 5889 - protein, 168 aa, Corynebacterium glutamicum
MRYFYDTEFIEDGRTIELVSIGIVAEDGREYYAVSTQFDSSKANAWVRANVLDKLPNPSSKVWKSADTIKREVYEFLTSTGPTPELWAWVGAYDHVLLAQMWGDMAGLPREIPRFTRELRQYWDMAGRPTLPELPNGNHDALIDARHNLAKFKVCMAALPLGKRDRVS

SEQ ID NO: 5890 - protein, 806 aa, Corynebacterium glutamicum
MDGTEGNLSQFQWRDMATNQTLRKALLVLSTIALLLTLWPSIFNVRAIESFVFFFHIDTDVYRAGANAFLHGENLYTQDYQVGSIQLPFTYPPISAALFVPLAILASSVAGIALTLISTVLLWWSVAIVLRRVLKGLTDADSRFVSYLILPMALSTEPVFQTLQFGQVNIILMALVLMDTFTKKPWLPRGFWIGLAASIKLTPAVFGLYFLVKKDWKGAGVAIASGVGFSALAFILSPSSSKIYWTETLNDPSRIGNLSYIANQSVRGTLSRMMHEQQDLVEKLWLVAVVLCLAAVAVAMWRVVRAGNPYGAVMLNSLIALLCSPVSWSHHWVWLIPIAIGLGASAWNQRRTAPGIAATAGVLALLTTIPMFITTFWNMPYDSESYPFWPLILQPSGNAYVVVVIAILIVAIVNPTVLGSGNKAVSGQAEKKSSPALLVVLAIAIFYLFANIWFKGNNQNKALIQYPLQTMEGRGLTDFGELIFEFAASSNQLVSLWIIGALNAIALAITLWFLLQRFAGKKSSWLIYLSTVAVALMMFSVQDALQFGSLTLVALALITVDVLSVREIGRRGLLTGLAAALFGWPILIVIGFLIHRRYAATITTTVTAAVLWILGILLNPDAFNLNLLRQWFSGRDGRDNLSFYAFLARWVSESPVMMFVWFIVALGLGAWAIHRTWSHGFKDLSAALSIALPTLVLPIVELHHLVLLLPLIAVLLRQGRVAISYLIGFIYLVSWTPQHLSYSTVFPLNDPAPEGYVAHFGWYLLVEPMAVAPAAIILGAFIACAATTPKTSQLVQVDKSSAENTK

SEQ ID NO: 5891 - protein, 483 aa, Corynebacterium glutamicum
MRKGISRVLSVAVASSIGFGTVLTGTGIAAAQDSAFDYGMDPNMNYNPIDDIKDRPEGLSNLPYFGSKLTSWGSSDATASSGVVTSALPQYTDPRYPLGKDDLPKATIDMEPEVLARLERFVGVDGDRIRQINAYSPSMGRTIPLVWVVPEDNTVPGPTVYALGGGDGGQGGQNWVTRTDLEELTSDNNINLIMPMLGSFSFYADWAGESESMGGAQQWETFLMHELPEPLEAAIGADGQRSIVGMSMSGGSVLNFATHDPNFYSSVGSFSGCAETNSWMGRRGIAATAYNGNVVPEQIFGEVDSDYSRYNDPLLNAAKLEEQDNLYIFAGSGVFSELDVIGDNAPIDEDAFKNRVLVGFEIEAMSNTCTHNLKAATDQMGIDNINYDFRPTGTHAWDYWNEALHRFFPLMMQGFGLDGGPIPVYNPNGVSSSESSSELSSDVSLGTVIGSVAGSSGSSEGSSVREFLAGSSGSSQSTGSFYE

SEQ ID NO: 5892 - protein, 68 aa, Corynebacterium glutamicum
MRKPLTSNVSEVLTFPSFQDFSSVQKAYSLSADCFFFEPRGTNTAAATPTMMNGATISRDKSNAATIT

SEQ ID NO: 5893 - protein, 59 aa, Corynebacterium glutamicum
MNKFMRIRLLIVAILIVLYVIVAALDLSREIVAPFIIVGVAAAVFVPRGSKKKQSADKE

SEQ ID NO: 5894 - protein, 396 aa, Corynebacterium glutamicum
MDWPDIAKGISILGVVLLHVSLAIPGGQDTMMSHLNALLDPLRMPLFFMVSGFFAVKVLNQSFGELFRGRLWFYLVPYLLWTPVNLYLHRLEGTVFTGRAPGTWEWYSGSMLSATNMYWFLYFLVIFNLFLWATRKLPAWAIVALVASLWLLMPAYSEIEILRKSIIYLPTFLIGAYFRPLISRFAEAATRPKAIVFAAVLYVSGLALGVISNGLRDSENHGASVLWLMNLRDTFAHALGGNLTGFDMDHLPGMIIRIVSLPAGIVLCVWLGRIKPVGEFLKLIGRHTLPIYIGHATGLSLIFGFGLRWNFMEIDNFSDSLWHHTNTWMVIAFACAMLGGYLTYLISRVPVLGWTLVPPKLPEPDKTPAKAQADSHVKAQSAKPMNASTSSKTYGI

SEQ ID NO: 5895 - protein, 245 aa, Corynebacterium glutamicum
MKNNWYRLFKYVLIGPFLRVYNRPEIEGKENIPAEGAAIMASNHEAVMDSFYFPLLCPRQLTFPAKAEYFTSPGIKGKMQKWFFTSVGQVPLDRTADNAMDSLMNTAKMVLDRGDLFGIYPEGSRSPDGRIYKGKTGMAYVAMETGTTVIPVAMIGSRDANPIGSWFPKPAKVRIKVGSPIDPLAFVKEHGLKPGTYEAARKLTDHVMFILADLTGQPYVDAYSKDVKNALEEGKGYPEGTAPSQ

SEQ ID NO: 5896 - protein, 381 aa, Corynebacterium glutamicum
MSASRKTLVVTNDFPPRIGGIQSYLRDFIATQDPESIVVFASTQNAEEAHAYDKTLDYEVIRWPRSVMLPTPTTAHAMAEIIREREIDNVWFGAAAPLALMAGTAKQAGASKVIASTHGHEVGWSMLPGSRQSLRKIGTEVDVLTYISQYTLRRFKSAFGSHPTFEHLPSGVDVKRFTPATPEDKSATRKKLGFTDTTPVIACNSRLVPRKGQDSLIKAMPQVIAARPDAQLLIVGSGRYESTLRRLATDVSQNVKFLGRLEYQDMINTLAAADIFAMPARTRGGGLDVEGLGIVYLEAQACGVPVIAGTSGGAPETVTPATGLVVEGSDVDKLSELLIELLDDPIRRAAMGAAGRAHVEAEWSWEIMGERLTNILQSEPR

SEQ ID NO: 5897 - protein, 349 aa, Corynebacterium glutamicum
MNEVDRGFLKMFGRRWVSVVASCVIASTLILVPSHSGAEEVDQLIADIEHVSQETSAQNEEVKQLEIDIEAREVTIKEVQEQSVSYREAADQASENVEAYRSEINRIAQAKYRGTVTDPLSIAVSAEDPQNVIDRMSYLSTLTKSTSDVVESLNAETEKSAEAVYQANRTKAEAEFQLGQLKVRQAELESEKEALDGRKSEIRDRVDALTPQEREMWVAKNGPLDIDLTDLLGLSAATSGAVDAALSKLGSPYGWGGIGPNEFDCSGLIYWAYQQMGKTLPRTSQAQMAGGTPVSRDELQPGDVIGYYPGATHVGLYIGDGKIVHASDYGIPVQVVSVDSAPFYGARRY

SEQ ID NO: 5898 - protein, 209 aa, Corynebacterium glutamicum
MGKHRRNNSNATRKAVAASAVALGATAAIASPAQAAEVVVPGTGISVDIAGIETTPGLNNVPGIDQWIPSLSSQAAPTAYAAVIDAPAAQAAPAASTGQAIVDAARTKIGSPYGWGATGPNAFDCSGLTSWAYSQVGKSIPRTSQAQAAQGTPVAYSDLQAGDIVAFYSGATHVGIYSGHGTVIHALNSSTPLSEHSLDYMPFHSAVRF

SEQ ID NO: 5899 - protein, 534 aa, Corynebacterium glutamicum
MGNNLDSRYTMASGIRRQINKVFPTHWSFMLGEIALYSFIVLLLTGVYLTLFFDPSITKVIYDGGYLPLNGVEMSRAYATALDISFEVRGGLFIRQMHHWAALLFVVSMLVHMLRIFFTGAFRRPREANWIIGVVLIILGMAEGFMGYSLPDDLLSGVGLRIMSAIIVGLPIIGTWMHWLIFGGDFPSDLMLDRFYIAHVLIIPAILLGLIAAHLALVWYQKHTQFPGAGRTENNVIGIRIMPLFAVKAVAFGLIVFGFLALLAGVTTINAIWNLGPYNPSQVSAGSQPDVYMLWTDGAARVMPAWELYLGNYTIPAVFWVAVMLGILVVLLVTYPFIERKFTGDDAHHNLLQRPRDVPVRTSLGVMALVFYILLTVSGGNDVYAMQFHVSLNAMTWIGRIGLIVGPAIAYFITYRLCIGLQRSDREVLEHGIETGIIKQMPNGAFIEVHQPLGPVDDHGHPIPLPYAGAAVPKQMNQLGYAEVETRGGFFGPDPEDIRAKAKEIEHANHIEEANTLRALNEANIERDKNEGKN

SEQ ID NO: 5900 - protein, 224 aa, Corynebacterium glutamicum
MIKNPWNPKEGPMDVQGDGTLWTSGWTLVENDVKVYLGRDTAAIAESHTDATGEHWSTTGVSRLVRMRPEDLAAASMETVFPLPAEMVNDGAEYDPAKDVYEHQMHSVHGPRNAVMLIRLRTADAEKVIEREGQESFHYGDYYAYSKICTHIGCPTSLYEAQTNRILCPCHQSQFDALHYGKPVFGPAARALPQLPITVDEEGYLIAAGNFIEPLGPAFWERKS

SEQ ID NO: 5901 - protein, 295 aa, Corynebacterium glutamicum
METNPQTPEGNSMAKPSAKKVKNRRKVRRTVAGALALTIGLSGAGILATAITPDAQVATAQRDDQALISEGKDLYDVACITCHGVNLQGVEDRGPSLVGVGEGAVYFQVHSGRMPILRNEAQAERKAPRYTEAQTLAIAAYVAANGGGPGLVYNEDGTLAMEELRGENYDGQITSADVARGGDLFRLNCASCHNFTGRGGALSSGKYAPNLDAANEQEIYQAMLTGPQNMPKFSDRQLSADEKKDIIAFIKSTKETPSPGGYSLGSLGPVAEGLFMWVFGILVLVAAAMWIGSRS

SEQ ID NO: 5902 - protein, 205 aa, Corynebacterium glutamicum
MTSAVGNTGMAAPQRVAALNRPNMVSVGTIVFLSQELMFFAGLFAMYFVSRANGLANGSWGEQTDHLNVPYALLITVILVSSSVTCQFGVFAAERGDVYGLRKWFLVTIILGSIFVIGQGYEYITLVGHGLTIQSSVYGSAFFITTGFHALHVIAGVMAFVVVLMRIHKSKFTPAQATAAMVVSYYWHFVDVVWIGLFITIYFIQ

SEQ ID NO: 5903 - protein, 51 aa, Corynebacterium glutamicum
MGEWADMNRIKLQKRLLFGFNQKLYVGLQWGEKLCDVSLRQKPAETTLGTL

SEQ ID NO: 5904 - protein, 143 aa, Corynebacterium glutamicum
MKSSAKLMYGPTVFMAAMAVIYIFATMHVSDGGSVKGVEWVGSVALVLSAGLTLMLGVYLHFTEVRVDVLPEDWEEAEVADKAGTLGFFSPSSIWPAAMSGAVGFLAFGVVYFHYWMIAVGLMLLIFTITKLNLQYGVPKEKH

SEQ ID NO: 5905 - protein, 359 aa, Corynebacterium glutamicum
MEQQNKRGLKRKALLGGVLGLGGLAMAGCEVAPPGGVLGDFLRMGWPDGITPEAVAMGNFWSWVWVAAWIIGIIMWGLFLTAIFAWGAKRAEKRGEGEFPKQLQYNVPLELVLTIVPIIIVMVLFFFTVQTQDKVTALDKNPEVTVDVTAYQWNWKFGYSEIDGSLAPGGQDYQGSDPERQAAAEASKKDPSGDNPIHGNSKSDVSYLEFNRIETLGTTDEIPVMVLPVNTPIEFNLASADVAHSFWVPEFLFKRDAYAHPEANKSQRVFQIEEITEEGAFVGRCAEMCGTYHAMMNFELRVVDRDSFAEYISFRDSNPDATNAQALEHIGQAPYATSTSPFVSDRTATRDGENTQSNA

SEQ ID NO: 5906 - protein, 640 aa, Corynebacterium glutamicum
MCGLLGILTANGNAEAFVPALERALPCMRHRGPDDAGTWHDADAAFGFNRLSIIDIAHSHQPLRWGPADEPDRYAMTFNGEIYNYVELRKELSDLGYAFNTSGDGEPIVVGFHHWGESVVEHLRGMFGIAIWDTKEKSLFLARDQFGIKPLFYATTEHGTVFSSEKKTILEMAEEMNLDLGLDKRTIEHYVDLQYVPEPDTLHAQISRLESGCTATVRPGGKLEQKRYFKPQFPVQKVVKGKEQDLFDRIAQVLEDSVEKHMRADVTVGSFLSGGIDSTAIAALAKRHNPDLLTFTTGFEREGYSEVDVAAESAAAIGAEHIVKIVSPEEYANAIPKIMWYLDDPVADPSLVPLYFVAAEARKHVKVVLSGEGADELFGGYTIYKEPLSLAPFEKIPSPLRKGLGKLSKVLPDGMKGKSLLERGSMTMEERYYGNARSFNFEQMQRVIPWAKREWDHREVTAPIYAQSRNFDPVARMQHLDLFTWMRGDILVKADKINMANSLELRVPFLDKEVFKVAETIPYDLKIANGTTKYALRRALEQIVPPHVLHRKKLGFPVPMRHWLAGDELFGWAQDTIKESGTEDIFNKQAVLDMLNEHRDGVSDHSRRLWTVLSFMVWHGIFVENRIDPQIEDRSYPVEL

SEQ ID NO: 5907 - protein, 114 aa, Corynebacterium glutamicum
MTAPSTNTGVILTESAASKAKALIDQEGRDDLSLRIAVQPGGCSGLRYQLYFDDRTLDGDKEDIVGGVRLVVDKMSTPYLLGAQIDFADTIEQQGFTIDNPNAGSSCACGDSFN

SEQ ID NO: 5908 - protein, 256 aa, Corynebacterium glutamicum
MCTPIPDLGGFPCSLLSVKLPWDKNKNNEGADAAGQDASSTPETATPDATEQKLPKGHTAPKGRPTPKRREVELERGVVGGQSLAPTDTYAQQRQKRKEFKASMTKEEFKAYKQKERDARVKRQRETQAAMDRGEDAYLMDRDKGEVRRFARDWVDSRRFLSNFVMPVAIALLVVMLIGNFNPSFAATSSMVAMVLMLGFLIEGITTGRRVNKAARTRFPGTTETGFGLGYYAYSRTIQPRKWRTPRARVEIGAEV

SEQ ID NO: 5909 - protein, 174 aa, Corynebacterium glutamicum
MRTLVLGGARSGKSAFAESLVGSGPVLYVATARPSGDDPEFAERIAVHAERRPTSWVLDEEGDVDKLLASPPAMPVLVDDLGTWLTHATDACDGWEASSAQLEAKMDLLIDAILHFQGEDLVIVSPEVGMGIVPEYKSGRLFRDRIGTLNQRVAAICERVVFVVAGLPLELKTF

SEQ ID NO: 5910 - protein, 363 aa, Corynebacterium glutamicum
MKELLMVPAELFARVEFPDHKILAQTKDFHDSLTKPPGSLGKLEQIGCFISACQGQIPPRPLNNSKIVVFAGDHGVATKGVSAYPSSVSLQMAENITNGGAAINVIARTTGTSVRLIDTSLDHEAWGDERVSRSCGSIDVEDAMTQEQVERALKIGKRIADQEVDAGADILIPGDLGIGNTTTAAALVGTFTLAEPVVVVGRGTGIDDEAWKLKVSAIRDAMFRARDLRQDPIAIARKISSPDLAAMAAFIAQAAVRRTPVLLDGVVVTAAALLANKLAPGARRWFIAGHRSTEPAHSVALNALALDPILELGMSLGEGSGAATALPLVKIAVDLMNDMSTFSSAGVDGPLNASSEAPEQNTE

SEQ ID NO: 5911 - protein, 307 aa, Corynebacterium glutamicum
MSGKAGFTPEDPEDSDNRHGNPLFEGIFTALNWMTVLPVPGASVFDRTTGARVMASLPFVGFVFGMFTAIIMWAIGPISGVIHVDGLLVAVLIVAFWELLNRFMHLDGLADVSDALGSYAAPPRAREILADPRTGLFGLATAMLSVLLQVAAVASLVDSTVWWMICFIPVLGRIAGQVTALKNHNAFSPTGFGALVIGTVKFWWIALWLLVTAALAFWCAELISPLSPLTSVNTPFVAGPFPAAINPAWLGGWVAITAVVACVFAALFSRRLSRSFGGLNGDCIGACIHLGASISAVMFAVVANAMV

SEQ ID NO: 5912 - protein, 79 aa, Corynebacterium glutamicum
MLRKQLTFHARTGKSRPLRMASKRPTKLKLREYTWDKLARPKSTQGDVMKSTHSQKTPPLYTIALATTANITAEIDAPR

SEQ ID NO: 5913 - protein, 238 aa, Corynebacterium glutamicum
MAENGQKVAVVTGGSSGIGAASARALAADGWKVIVAARRLERLEALAQEIGGTAVALDVTDQESVNAFSVTVGEVDLLVNNAGGAKGLDSIHDANIDDWTWMYETNVLGTLRVTKALMDGLIARDGHVINIGSIAGENPYIGGAGYNAAKFGVAAFNRVLRLETHQQTLRVSEIDPGRVATEEFSLVRFGGDKERAEAVYDDVLNLTAEDIAESVRWVASLPKHMNIDRMRITPRDQV

SEQ ID NO: 5914 - protein, 379 aa, Corynebacterium glutamicum
MYLSGSRCTLKSMTSLEFTVTRTENPTSPDRLKEILAAPKFGKFFTDHMVTIDWNESEGWHNAQLVPYAPIPMDPATTVFHYGQAIFEGIKAYRHSDETIKTFRPDENAERMQRSAARMAMPQLPTEDFIKALELLVDADQDWVPEYGGEASLYLRPFMISTEIGLGVSPADAYKFLVIASPVGAYFTGGIKPVSVWLSEDYVRAAPGGTGDAKFAGNYAASLLAQSQAAEKGCDQVVWLDAIEHKYIEEMGGMNLGFIYRNGDQVKLVTPELSGSLLPGITRKSLLQVARDLGYEVEERKITTTEWEEDAKSGAMTEAFACGTAAVITPVGTVKSAHGTFEVNNNEVGEITMKLRETLTGIQQGNVEDQNGWLYPLVG

SEQ ID NO: 5915 - protein, 500 aa, Corynebacterium glutamicum
MSKDATLPVRGTVAELKLEKKLPKKIDAIIVAIFEGEDSIELAGGEILDFIFSTEQQADILTQLEAVGAKATANSITRVPGTDVAPVIAVGLGKADLLDDETLRRASGTAARSLGGFENVATTIGDLGLAAAVTGFGLGSYSYAGLRKETEESKDKTTTVTFISTGKDDKDVFVEAQIIVESVLLARDLVNTPSSHLYPESYSVIASNEASKHGLQTTILDEKQLADQGFGGILAVGNGSSRKPRLLRIDWKPRKAKKSIALVGKGITFDTGGISIKPGASMENMISDMGGSASVLATIIAAARLNLSINVSAFLPMAENMPSGDAFRPGDVITHFGGITSEILNTDAEGRLILADAIAYASEDKPDYLIDAATLTGAQLVALGLRTSGVMGTDEFRDSVAKTGREVGEQAWAMPLPEELDEQVKSPVADLRNVTNSRFAGMSAAGRYLQEFVGADIEWAHVDIAGPAYNTAGEFGYTPKRATGQPVRTFVQVLKDLSES

SEQ ID NO: 5916 - protein, 131 aa, Corynebacterium glutamicum
MFNLFGRKTPRSNLRPPRGPGDTVRPEDLKFLMQWVQDKPFVEAFVEPETLVNEMSVVLVDAHGVFVRRRIGGPKGIDVIAKKLGVPVYDVEETGYPQRMRERIEYERILRKREEQKARRAKFERGENPDL

SEQ ID NO: 5917 - protein, 675 aa, Corynebacterium glutamicum
MAFSVEMPELGESVTEGTITQWLKSVGDTVEVDEPLLEVSTDKVDTEIPSPVAGVILEIKAEEDDTVDVGGVIAIIGDADETPANEAPADEAPAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEEPKKEEPKKEAATTPAAASATVSASGDNVPYVTPLVRKLAEKHGVDLNTVTGTGIGGRIRKQDVLAAANGEAAPAEAAAPVSAWSTKSVDPEKAKLRGTTQKVNRIREITAMKTVEALQISAQLTQLHEVDMTRVAELRKKNKPAFIEKHGVNLTYLPFFVKAVVEALVSHPNVNASFNAKTKEMTYHSSVNLSIAVDTPAGLLTPVIHDAQDLSIPEIAKAIVDLADRSRNNKLKPNDLSGGTFTITNIGSEGALSDTPILVPPQAGILGTGAIVKRPVVITEDGIDSIAIRQMVFLPLTYDHQVVDGADAGRFLTTIKDRLETANFEGDLQL

SEQ ID NO: 5918 - protein, 455 aa, Corynebacterium glutamicum
MGNQSLDNCLHEEWQVSEVHTVLLDERGLVLLTQLSNASHIDLVQLGELSRNLQSLDGLHRGDLTDAVDLLSGTTELSLLRVNRLSGPSGNRSSSLSRCSLAVRSSQNILLADTATDTGTGHGVQVNAVLFSKLAHQWGDVWNVVARSGHSCGCRSRCSSCFLLGLFLLGLFLLWLFLNWFLLFGRSCFLFGRCCSCVCVTDAGDDCADVDGVVFVCKDLHDGACYWGWDFGVDLVGGDLKKWFVYFDGVADSLEPLGNGAFGDGFAEFWHFHIGCGASCCWSFRSCLLLWLFLNWFFLFGRSCFLFGRCCSCVCVTDAGDDCADVDGVVFVCKDLHDGACYWGWDFGVDLVGGDLKKWFVYFDGVADSLEPLGNGAFGDGFAEFWHFHIGCGASCCWSFRSCLLLWLFLNWFFLFGRSWCLVGRSFVGRSLISIADYCNDTADVDGVILFSLNL

SEQ ID NO: 5919 - protein, 251 aa, Corynebacterium glutamicum
MTAPRDPFFPADLSIRASAEPIEIQRLGLIDYQEAWDYQAELATRRANDEIPDQLLILEHPSVYTAGKRTQPEDLPTNGLPVINADRGGRITWHGPGQLVIYPIIKLADPIDVVDYVRRLEEALIQVVGDMGVAGAGRIDGRSGVWVPAHDGWVDSKVAAIGIRITRGVAMHGVAINCNNTLDFYEHIIPCGIADAGLSTLSRELKRDVSVEELVEPSIRALDDALAGRLVVSDHSFGSAPDPTKNLPKRG

SEQ ID NO: 5920 - protein, 348 aa, Corynebacterium glutamicum
MTIAPEGRRLLRVEARNSETPIETKPRWIRNQVKNGPEYQDMKERVAGASLHTVCQEAGCPNIHECWESREATFLIGGANCSRRCDFCMINSARPEPLDRGEPLRVAESVREMQLNYSTITGVTRDDLDDEGAWLYSEVVRKIHELNPHTGVENLVPDFSGKKDLLQEVFESRPEVFAHNVETVPRIFKRIRPAFRYERSLDVIRQARDFGLVTKSNLILGMGETKEEITEALQDLHDAGCDIITITQYLRPGPLFHPIERWVKPEEFLEHADAAKEMGFAAVMSGPLVRSSYRAGRLYAQAMEFRGEEIPAHLAHLKDTSGGSTAQEASTLLERYGASEDTPVVSFN

SEQ ID NO: 5921 - protein, 260 aa, Corynebacterium glutamicum
MADAKKQADKAAKKQVRAAKKAQRKETRSQMWQVFNMQRKQDKALIPLLLLAILGIPLVLFLIGLIWGGQWWMLPIGIAAGVVAAMFIFTRRVERDVYKRAEGQQGAAGWAVENLRSGVGMTWRTKTAVAVTTQMDAVHRVIGLCGVVLVGEGSPHRLKPMLAQQKKRLNRVAPGVPVYEIITGNGEGQTPIAKLQRELVKLPRNYKKNDVAALAARIEAMDNVGNAPGGSLPKGPLPKGASMSGMNRRARRQAERKGEA

SEQ ID NO: 5922 - protein, 539 aa, Corynebacterium glutamicum
MSFLVENQLLALVVIMTVGLLLGRIKIFGFRLGVAAVLFVGLALSTIEPDISVPSLIYVVGLSLFVYTIGLEAGPGFFTSMKTTGLRNNALTLGAIIATTALAWALITVLNIDAASGAGMLTGALTNTPAMAAVVDALPSLIDDTGQLHLIAELPVVAYSLAYPLGVLIVILSIAIFSSVFKVDHNKEAEEAGVAVQELKGRRIRVTVADLPALENIPELLNLHVIVSRVERDGEQFIPLYGEHARIGDVLTVVGADEELNRAEKAIGELIDGDPYSNVELDYRRIFVSNTAVVGTPLSKLQPLFKDMLITRIRRGDTDLVASSDMTLQLGDRVRVVAPAEKLREATQLLGDSYKKLSDFNLLPLAAGLMIGVLVGMVEFPLPGGSSLKLGNAGGPLVVALLLGMINRTGKFVWQIPYGANLALRQLGITLFLAAIGTSAGAGFRSAISDPQSLTIIGFGALLTLFISITVLFVGHKLMKIPFGETAGILAGTQTHPAVLSYVSDASRNELPAMGYTSVYPLAMIAKILAAQTLLFLLI

SEQ ID NO: 5923 - protein, 401 aa, Corynebacterium glutamicum; identical to SEQ ID NO: 3705

SEQ ID NO: 5924 - protein, 100 aa, Corynebacterium glutamicum; identical to SEQ ID NO: 3704

SEQ ID NO: 5925 - protein, 157 aa, Corynebacterium glutamicum
MAKPKRSWLDGPEIPADFDDPDAPGRWPGEKLGLPQEGAGSLSSVARRIGGVCVDWGVSWVIAIVLSNFTDVLGDVATSTLIIFVILGWLTGWIFARTPGHAVFGMGLARVDAEERVGWWRALVRPLLTILILPAVMVDADGRGLHDKATGTAVIRG

SEQ ID NO: 5926 - protein, 71 aa, Corynebacterium glutamicum
MNHKLFGSKQFRKEKEMGLRIRPNEMKVWETFTLERQLEVIINADHLLLFRGEPHGTVSLSDVVASELIGI

SEQ ID NO: 5927 - protein, 325 aa, Corynebacterium glutamicum
MHQTRRRASGEPRRLRKQHRQAPGVEQAPPPPHKCPSPTAQLCFDRLGECANWCDRLPQKTRSQSQSARCHQAWPYGPRQKTTVQALDYLTEIQYSSCIPFLISHAGLITLRMLQLCHRISDDHAETLISDRHLRNREPCNIHVLVIADVRLIGITRNNATHGRIHVARHITILIGHRPHRAHAKQRLNADIKAGFLLDFTHRSHMRLLIRITNTGRWSPLTSISALDQQHIRNHMERRPRRNITNNNRSYSRQPQRILTDLLPQTNNELWNRHAAKPLQLVIFDSQVTPALRHHHLGLEYGLQQSVRCTSRPSNHPRTHDTKRP

SEQ ID NO: 5928 - protein, 133 aa, Corynebacterium glutamicum
MSIEFPLGNPAPAQWFSGEVHMAKLDDNVQIETVNVSFEAGGRTNWHTHPVGQNIIVLSGLGIYEAEGEPARLLEPGDVVFAAAGVRHWHGAVSGAPMFHVVVNLKGIDGETVDWEEPVDEEHYRSVSAELQR

SEQ ID NO: 5929 - protein, 200 aa, Corynebacterium glutamicum
MVVSQGWRNLGVKDYQLERFCCMAVPEFIVSLREKVGQDPLWLPAVTAVVIRDVPPGSPFHVVPDVLLVKRADTGEWTPPTGICDPDEQPHVTAVREVKEETGLDVSVEALLGVGAVGPVTYQNGDVASYMDTTMRCVVSGDSDEPHVGDDENVDVAWFPISKMPVTNQRFRMVIADAVAQLKHPQGYKPRMGYEKRNAR

SEQ ID NO: 5930 - protein, 283 aa, Corynebacterium glutamicum
MTPNGPELGRSEMVPTENSIELAIQAEAQGFRGMWVRDVPLAVPQGITVTDKQATYLDDPFLMLGAMASVTSTIALGTAATVLPLRHPLHVAKSALTLDRLSHGRFVLGIGSGDRPEEFEIFGKSLDNRRADIQSGWAILRAALSPDPAMRADLEFAPTTPPEAQIPMIAVGSARQTVQWIARNADGWATYYRPAEAQVGRLDLWDKARGGTRPLLISSMGLNLTEGNTHKEITLGVEVGSQELIEHLHRLSELGIDHVIFNIQRRPASEVLTQIYEEVLPHL

SEQ ID NO: 5931 - protein, 131 aa, Corynebacterium glutamicum
MPVPALPFGETAMVGHMSNDHPYSPAKRVGNFIFVSGALSVDKDYQPVVGRKEAVDAALERMRERLATAGGELKDVVKLTYFVTDISLREECNEQFREHFLEGRPARSFVGASSLPYGATVEIDAIAMIED

SEQ ID NO: 5932 - protein, 81 aa, Corynebacterium glutamicum
MSVLGCALKMTAPDYPSFSKLEDNNKKNLTAVEILNPAPVSKWNLYVLIGCSVLAVGLVLLGPWLYPYVEAHIDGFWAQFQ

SEQ ID NO: 5933 - protein, 87 aa, Corynebacterium glutamicum
MFDRPNEITRYGDLLELSPETVDVCLNVGVKPRPEQHQPDREHRTTNENIQVPLGHRRWIKDFNCGEILLVVVLEFREAGVIGSCHL

SEQ ID NO: 5934 - protein, 441 aa, Corynebacterium glutamicum
MKNNDQRPSPRPHPREKVTTRALIVWAAACLVYMAAITSRTSFGVAGVEAIDRFQVDATRIAVFTSVQVGVYAFAQIPMGILIDKFGPRKLLAIGALVMGIGQLILGFTDSYSIAIIARVFIGAGDASIFLSVMRILPFWFPLKHTPIFTQLTTCLGQLGQFFSAVPFMALLGAQGWPVAFVSLGSVVALIAIAALVAVRDTPDPQPKPVESAQEADKPSLRASLKLIVRNPITWQGFFIHYVLMVWQTVFSMMWGVPLMTLGMGLSATTAGLVLSINTLCMVVSAPIIGIISARLGYRRDVVAIALSFVQSAVWLVFLASDAPRGLMAIILVNIVMGLTTAASGYGFDTIRERLDRKILAAGTGLANMGGFLSSMVAAQVMGFLLDHSAHGSTYTWVDFRFGFLAILVTWAVGVTGFVVARLKGGPGRRLLAQIRSTKDF

SEQ ID NO: 5935 - protein, 187 aa, Corynebacterium glutamicum
MDRAADYSPRLGLPRTFKDRVKPVGVERGKVSAKALVVWLTAMCVYIVAIAGRTSFGVAGVHAIDRFDIDASRLAVFTSVQVGVYVLAQIPMGMLVDRFDARKLLLAGALILAAGQLILGFTDSYMIAIFARVLISVGDSSAFLSVMRLLPNWFPMSWTPVLQQLTGAFGFVGQFSPRCRFCTYSTP

SEQ ID NO: 5936 - protein, 148 aa, Corynebacterium glutamicum
MDTCVAAAHGRFWLCGAVFSAVPFLHILNTLGWTIPFASLGAVGIIVAIAAAILVRDAPASSEPVRRGEASISIAFRLKSVLTSLYCWQGVFNHWVSMGPVMVFLLLWGTPTLTLGLDISSGEVGTVLTIFAVATVITGRFPASCRRG

SEQ ID NO: 5937 - protein, 65 aa, Corynebacterium glutamicum
MLIDASPRLTGSLLAGASRTKMAAAIATMMPTAPRDAKGIVHPKVLSMCKNGTAEKTAPQSQKRP

SEQ ID NO: 5938 - protein, 135 aa, Corynebacterium glutamicum
MIGFVTPMIQAALWIVLFLFADRLSNPLVFVSAIMFAISFSSPVANFGFDTICEKLDRRVMVAGTGMANMSAYICAMLATQIIGFLLDWNADGHAYTWSNFQVAWLGLGAVWLAGMIGLAVCLLLQRRKNIAFRR

SEQ ID NO: 5939 - protein, 181 aa, Corynebacterium glutamicum
MVRSLGCKAHFGTRQEVRNSTMAIKLSIDLSDATFAELSAVIGYAHQLGVDADEKLTFEGTVLNIEFDGDLQFDDVFDAFDEAEIELDNPREDGPIYADDLIDEDEDYRAQTKSQINDEVINEIRDGISSFVDGIVNGLGQGRRGGRYGDFGGPRGPRGPRNDGPFGPFGPFGPGYRGPRF

SEQ ID NO: 5940 - protein, 215 aa, Corynebacterium glutamicum
MTSIIASNSDLSEALRTHTAQAHEEAEHSTFMNDLLTGKLDAQAFIKLQEQSWLFYTALEAAARACAEDSRAAGLLDPRLERKETLEADLDKLHENTTWRDNVTATAATASYVERLESIEAAKDFPRLVAHHYVRYLGDLSGGQVIARLVNREYGVSEEALSFYCFEDLGKLKPYKDNYRAELDALELTAEERAALLDEASDAFRFNQQVFQALA

SEQ ID NO: 5941 - protein, 1045 aa, Corynebacterium glutamicum
MSGPLRSERKVVGFVRDPLPKVGSLSLKSEHAQADLEHLGWRNVESLDLLWGLSGAGDPDVALNLLIRLYQALEAIGEDARNELDQEIRQDEKLRVRLFALLGGSSAVGDHLVANPLQWKLLKLDAPSREEMFQALLESVKAQPAVLEVEDFSDAHNIARDDLSTPGFYTASVTGPEAERVLKWTYRTLLTRIAAHDLAGTYPTDMRRKGGDPVPFSTVTMQLSDLADAALTAALAVAIANVYGEKPVDSALSVIAMGKCGAQELNYISDVDVVFVAEPANSKSTRTAAELIRIGSNSFFEVDAALRPEGKSGALVRSLDSHMAYYKRWAETWEFQALLKARPMTGDINLGQSYVDALSPLIWTASQRESFVTDVQAMRRRVLDNVPEDLRDRELKLGRGGLRDVEFAVQLLQMVHGRIDETLRVRSTVNALHVLVDQGYVGREDGHNLIESYEFLRLLEHRLQLERIKRTHLLPKPDDRMNMRWLARASGFTGSMEQSSAKAMERHLRKVRLQIQSLHSQLFYRPLLNSVVNLSADAIRLSPDAAKLQLAALGYLHPSRAYEHLTALASGASRKAKIQAMLLPTLMEWLSQTAEPDAGLLNYRKLSDASYDRSWFLRMLRDEGVVGQRLMRILGNSPYISELIISTPDFMKQLGDAASGPKLLATAPTQVVKAIKATVSRHESPDRAIQAARSLRRQELARIASADLLNMLTVQEVCQSLSLVWDAVLDAALDAEIRAALNDPQKPDQPLANISVIGMGRLGGAELGYGSDADVMFVCEPVAGVEEHEAVTWSIAICDSMRSRLAQPSGDPPLEVDLGLRPEGRSGAIVRTVDSYVKYYEKWGETWEIQALLRAAWVAGDRELGIKFLESIDRFRYPVDGATQAQLREVRRIKARVDNERLPRGADRNTHTKLGRGALTDIEWTVQLLTMMHAHEIPELHNTSTLEVLEVLEKHQIINPVQVQTLREAWLTATAARNALVLVRGKRLDQLPTPGPHLAQVAGASGWDPNEYQEYLENYLKVTRKSRQVVDEVFWGVDSMEQREF

SEQ ID NO: 5942 - protein, 446 aa, Corynebacterium glutamicum
MNSEQEFVLSAIEERDIKFVRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 5943 - protein, 368 aa, Corynebacterium glutamicum
MTLSHFSDNVTDAQDSYRQILEESIISHLGFCALRGWTPADLRHEFSADIDPLLFHALPEIAYSCSDEMYTLWVNGTRAAETSHLPVMTLEKILTELPKLSTLPDWAMLAELHALDNQDTSPMTPAQAKAHHRITALLKKAESTNFEEEAEALILKAETLRQQYRIESLLINSYDQDVQARSSTIRASRVYLEAPWIRHQYKLLNAIARVHSSEALLITKSGICTLFGEQDDVAHIIDLFNSLNRQRAHFMKTSAGARIAQLNGETSSYRRSFMISYASQISRLLISAKEDAFNELAGQAPLAHSAIVPVLENRSVRSKEALKETFPNMRTMTFKSTNRRGIIDGFNAANESHLGGESASLEDSTFMF

SEQ ID NO: 5944 - protein, 609 aa, Corynebacterium glutamicum
MDTTMGQHLEVETKFSVSESTQIPQLEAIAEVDHIDRTEIHQLSAVYFDTVDLRLTRAKITLRRRTGGNDAGWHIKFPGTIGRREVQAPLDGEGATETLPPRELLGHIRALIQGRELTPIAQVDNERHMSYLADEDGAVIAEFCDDHVSTVSHLPGGVRKQWREWEFELADGTLAEEAISVLLQSAQSVLTAAGAFVSNSPSKLVSALDESVNHAPKPPQMAQLDKNDPARGVLAAIAANASKIAEYDPRVRADEYDSVHQMRVATRELRSHLQTFEGILGGEDYLNLEKELKVLANILGRARDAEVVEERLSNLINTEVGDSIEEETKKELLEDLGAEYRREHERVVRALDNDRYTDLLQALENLLVDPPLITEVEEPEATEAPESAETTESTDVSEATEEADAEAESVEEATEQEESADAPESADLDALDEEYSPGSQAPVEEPKEPKKVDAALVLLEHLDKAHVKLVKLEKKARSQWDDLSIPMLEREENFHNLRKAAKKLRYSAEAVGKATTVETKKLYKACSGLQSVLGDYQDAITSRNELLRRAQVARRQGRDTFAYGILYQHEQTLSREYLTGYSDAFKSVEKAYAKLAEDTAKRSKKNKRK

SEQ ID NO: 5945 - protein, 60 aa, Corynebacterium glutamicum
MAKEDLKWFYDLATGKVFQGKVSGFETRMGPYDTEEEAHHAISIAAARTKAAEIWDDKED

SEQ ID NO: 5946 - protein, 431 aa, Corynebacterium glutamicum
MAIWQPTLTGPHGAQVGSSPTELLEACVAFHRTFFDVNPKGAATAPATWTLIGEHSDYAGGVVLAANANWRTAVAVNKNRDDVVNVCVVDVEGGVEKHSLSTADIAARAHAHMKSHDVLGRQTTPPQPEGGVAARLGGIAWTMIHKQMLSRDTKGLDITVLSTIPEGVGLGENSAMDVALALALYRENIEEAPTKARIAEICSQSAFMFSETSVLRARHTVALRGETGQISVVDYADGSVTQAPHPVSRSAGLSAFVVAAQTETDPSIYREIYARHAFIDEAARAFSVESLRLLPDASTRVVDWLQAVIEVTGREDLPSIEQAQRWLNLWENETRRAQRTANALRSRRLSEFSELLMESQDDLSDTFDFPPADLALARLCVERGATAARSTSARGVIALVDAHHAHNFAADLSEDGLLVVPLGHGDVAEQG

SEQ ID NO: 5947 - protein, 422 aa, Corynebacterium glutamicum
MPFVTIDPVGSRDLDQAVLIEEIDSGFRVHYAIADVAAFVEPGSELEKISLHRGQTIYLPDSPARLHPEELSEDAASLLEGQTRPAVVWSIDLDERGEVTATKVRRGLVKSRARLDYDQAQIDAENGRLHPSISLLPKVGQLRQESALRREAVNLSIPSQRVVKVPNDDAGEHYEIVIEPRPHIMDYNSEISLLTGMVAGEMMVKAGHGLLRTLAPATKESEATFRSEAQALGFEIAPEQPIGEFLQSVDPNTPKGMAIQREAQKLLRGSGYASVKNGDSEVHSGVGGYYAHVTAPLRRLIDRFATEHCLAIASGTDVPEWVTRVEEQVLDTMKYSSILASQVDNACLDLTEATVLKYWEGQNFNAVVVASEPEKNSARLFVYKPPVLAKCIGAPEQGTNQDVTLVTANLKKREVLFAWPAD

SEQ ID NO: 5948 - protein, 162 aa, Corynebacterium glutamicum
MTRLRRGYEGQNLAPHRTLVPLVQSRGLLHRASCAPIVPQRKSICRGVEFPWAQKGRGSPDRSWYGSSSFSPLKAILRGFHFGTGGANVISAGLLIKDSPHSRGQTFKSNIFLQSNDPNLQKSTTIGQVKAICGVYSHIHSTPGKPKDEHSIPQQPERQKHK

SEQ ID NO: 5949 - protein, 382 aa, Corynebacterium glutamicum
MKLVIEADGGSRGNPGVAGSGTVVYSDNKAEVLKEIAYVVGTKATNNVAEYRGLLEGLKAARELGATSVDVYMDSKLVVEQMSGRWKIKHPDMKVLAIEAKEIASEIGSVSYTWIPREKNKRADALSNVAMDAAAAGKPVGVVGDSASVSSASSVAGSEKEDLNCTETKPTNWNGATTDPTRFLLLRHGQTAMSVARLYSGRSNPELSELGEKQAAAAARRLAQTGGIDAIVSSPLTRTMQTAEAAAAALGMKVRVIDDLIETDFGLWDGKSFSEAHEQDPELHTKWLTDSSVAPPGGESLQTVNRRVKKARESLQREYGAANVLVVSHVTPIKAIMRQALDAGPSFFQKAHLDLASLSIAEFYEDGPTCVRLFNDTSHLEA

SEQ ID NO: 5950 - protein, 243 aa, Corynebacterium glutamicum
MVFLRDVSDEVRATFWALWNLIFGGVADVGDTGCRENHGASAAGAAVEECCAYAVFEALCMEFCQCFGGKFLFQVCDDYCWVFTFWGCCCGGFCGCAGVGNFAFGVFDARLCEVAVVAQRMDFIVSFLQFAHEVSDAGLRSVDVVVEVAATLFVSFCTECVLAVFLAAAQFAFVGLNAQDFVFHVIDSHLCSGCSVAVAGKFSDSLVYSFLLRGGLRCGVGVLGAQGGGELQQGFVQRWVQLH

SEQ ID NO: 5951 - protein, 239 aa, Corynebacterium glutamicum
MKLDPSLHKTLLQLATTLRTQNANSAPKTTPEQEAVDKAVAELSRNRDAASAAQMAVDDMENEILRIQSDERKLRRRKKDGQDALGAETDEERRRDLNHDVYTAKSRIADLMSELQEAHNEIHALRNNRDLAQSRVKDTERKVADARAAAEAAAAATPEGEDPAVVIAHLEEKLPSEALAEFHAQRLENGVGAALFNGRSCSGCAMVLPATGISDIRNTPKDEVPQCPECGSYLITDIS

SEQ ID NO: 5952 - protein, 380 aa, Corynebacterium glutamicum
MSDVTVGDIRRILDEAYPPALAESWDKVGLICGDPTESVKRVGLALDCTQAVADKAVDMGLDMLIIHHPLLLRGVTSVAADEPKGKVIHTLIRGGVALFSAHTNADSARPGVNDKLAELVGITAGRPIATRLLGGMDKWGVHVLPKDAAYLKKMLFDAGAGAIGDYRECAFEIEGTGQFRPVEGANPAEGDVDKLFKSLELRIEFVAPRNLRARLTSVLREAHPYEEPAFDIVEMHSAESLENATGLGRVGELPEPMRLADFVQQVANNLPVTEWGVRATGDPEQMVSRVAVSSGSGDSFLNDVIKLGVDVYVTSDLRHHPVDEYLREGGPAVIDTAHWASEFPWTSQAQEILQDKAPQVEVDVISIRTDPWTMSARAVN

SEQ ID NO: 5953 - protein, 218 aa, Corynebacterium glutamicum
MTTPSKKTLLFDLDGTLVDSFPGIRTSFLHTLHEKNWEIPSEERISQVPGPPMEWTFQDLGMTPEQAQDALQTYLEHYGQVGWDLSEAFPGMRDLLIRLKYEGFRLCTATSKGEFFAEKVLRKFEMFDLFEFMGAATDNGNRRSKSAVIKHVLDSVGLDEPNDILMIGDRSHDIEGSSEFGIDCVAVTWGYGSKTEWDAARYTVSTAEELERIIHDWA

SEQ ID NO: 5954 - protein, 157 aa, Corynebacterium glutamicum
MEIVFVCTGNICRSPMSEVIAKAKAEEAGLEDNVIFSSCGMGNWHVGQPADKRALAELKSAGYNGDTHRAAQLGPEHMRADLFVALDSGHAGELAATGVPNDKIRLMRSFDPESNPTDDVADPYYGTSQDFVLTRENIEDAMPGLLEWVRDHIRTDS

SEQ ID NO: 5955 - protein, 318 aa, Corynebacterium glutamicum
MSSRYSGNSRSRTKPKGWRAFLSPGWIISALLIVSFSYAAISMLAPWQLHKDDDIVARNEQITEAFERDVVPYAELFDASGQIPSSQEFFRVSLTGQYLPDSEVLLRLRPVDSGPAFQSLTPFELENGQIVLVNRGYESSEGTIVPEIEPAPSTPVTITGFARKNEGLPGSAPMEDSGYTQVYGINTEQISDVTGLDLGTDYVQVAEGEPGVLNPMPLPQMDRGNHLSYGFQWIAFGIMAPLGLGYFIWAEMRERRRDKAEREQMAELNTLEPVVETPEVVETAEPTITPAASKRRSRYGDQHRNHYEKISKRDQERF

SEQ ID NO: 5956 - protein, 131 aa, Corynebacterium glutamicum
MVAGANRHDSPLLAATLDTLGRFGGCLPDQITVHLDAGYDSKKTRRLLSERGYSWVISTKGKPLQAGARWVVERTNSWHNRGFKKLSICTERCTRVVEAFIALANAVIILRRLIKQAWTSYRWDTRPGHRP

SEQ ID NO: 5957 - protein, 81 aa, Corynebacterium glutamicum
MPALSSSIIDPLWRQFSALIPPVINTHPLGCHRPRIADRIIFDKLIAVLVLGASYIKIFRFHMLSHHATHPPRRVDHCRDI

SEQ ID NO: 5958 - protein, 126 aa, Corynebacterium glutamicum
MTNSAESTSSKRPGRPRKDGHDEKIIDATLRLIDSNRPVTVNAVVKESGVSRAAVYRRWPGLVDLVAEALDAGRAPVEIDTSGDIKETLIDGLFTNQAKTTGVSYPRQRFRKRLELVMSDQELQLA

SEQ ID NO: 5959 - protein, 66 aa, Corynebacterium glutamicum
MRRRREANIRALQVVQEKGQIRADLDIEACLDAILGVFYYQSVARGVNFTDQGTMQRCNDAEKLSR

SEQ ID NO: 5960 - protein, 143 aa, Corynebacterium glutamicum
MADAPGAVKQGAQDYAQLLGIQSGHIVQEIGWDEDSDTLISESIEDAIGEELLDEETDELCDVVLLWWREDDGDLVDGLVDSIRSLAENGRIWVLTPGIGKEGALAPGVISESAQLAGLVQTKAERLGNWQGSCLVQRGNKKP

SEQ ID NO: 5961 - protein, 115 aa, Corynebacterium glutamicum
MNHLSLEFFPFPPPLRSRINEFNHWPAINFSSFQSWISTILFKIMVARFFIKPSPKGHQTCSFMRFASNVRETSHLAGNYPIILCKTLQSGMNMQLVSVEMFFKKSTTIARKHTD

SEQ ID NO: 5962 - protein, 904 aa, Corynebacterium glutamicum
MIRDGVASYLNDSDPEETNEWMDSLDGLLQESSPERARYLMLRLLERASAKRVSLPPMTSTDYVNTIPTSMEPEFPGDEEMEKRYRRWIRWNAAIMVHRAQRPGIGVGGHISTYAGAAPLYEVGFNHFFRGKDHPGGGDQIFFQGHASPGMYARAFMEGRLSEDDLDGFRQEVSREQGGIPSYPHPHGMKDFWEFPTVSMGLGPMDAIYQARFNRYLENRGIKDTSDQHVWAFLGDGEMDEPESRGLIQQAALNNLDNLTFVVNCNLQRLDGPVRGNTKIIQELESFFRGAGWSVIKVVWGREWDELLEKDQDGALVEIMNNTSDGDYQTFKANDGAYVREHFFGRDPRTAKLVENMTDEEIWKLPRGGHDYRKVYAAYKRALETKDRPTVILAHTIKGYGLGHNFEGRNATHQMKKLTLDDLKLFRDKQGIPITDEQLEKDPYLPPYYHPGEDAPEIKYMKERRAALGGYLPERRENYDPIQVPPLDKLRSVRKGSGKQQIATTMATVRTFKELMRDKGLADRLVPIIPDEARTFGLDSWFPTLKIYNPHGQNYVPVDHDLMLSYREAPEGQILHEGINEAGSVASFIAAGTSYATHGKAMIPLYIFYSMFGFQRTGDSIWAAADQMARGFLLGATAGRTTLTGEGLQHMDGHSPVLASTNEGVETYDPSFAYEIAHLVHRGIDRMYGPGKGEDVIYYITIYNEPTPQPAEPEGLDVEGLHKGIYLYSRGEGTGHEANILASGVGMQWALKAASILEADYGVRANIYSATSWVNLARDGAARNKAQLRNPGADAGEAFVTTQLKQTSGPYVAVSDFSTDLPNQIREWVPGDYTVLGADGFGFSDTRPAARRFFNIDAESIVVAVLNSLAREGKIDVSVAAQAAEKFKLDDPTSVSVDPNAPEE

SEQ ID NO: 5963 - protein, 492 aa, Corynebacterium glutamicum
MAGAFTAGVEVDALVQAFYVQSFWLSWLWGWLVVDGDVVDNIFTLAWAVHAVDATVNQVCDLVRKGWVVGLDTLVGGSQDRGVSIHVLEAFTGQGGATCGSAQEEATCHLIGCCPDGVTGALESEHRVEDVQRNHGLAVGGVGGTRSDERCHGTSLVDAFVQDLSFRCLTVGEHQVVVNRHVVLTVRVVDLQGWEPRVKTEGTCLIRNDWDKAISQALIAHQFLEGTNSRHGGSDLLLAGALTDRAKLIQWWNLNWIVVLTTLWQVATERCATFLHVLDFRSVFTWVVVRRKVRILLQLLIGDWDALLVAEQLQIIKRQLLHLVGCVTAFEVVAESVALNGVSKDDGWAILGLKSSLVGCVNLAVIVAATWKLPDFFVGHVLNELCGAWVTSEEVLTNICAVVSLEGLVVTIGGVVHDLNKCTILVLLQKFIPLATPNNLDHRPACATEEGLEFLDDLGVTADRSVETLQVAVNHEGQVVQVVQCSLLDETT

SEQ ID NO: 5964 - protein, 263 aa, Corynebacterium glutamicum
MLSINGISKTFFPGTVNERRALQQLKLDMAEGDFVTVIGSNGAGKSTLLNAVSGRLLVDSGEISIDGNKVNKMSEHKRARYIGRVFQDPLAGTAPNLTIEENLAIALLRGKRRGLGFALTSKRREQFKQELERLELGLENRLTAKVGLLSGGQRQALSLLMAGFTQPKIMLLDEHTAALDPQRAELVTTLTEKIVADGNLTTLMVTHNMEQAIRLGNRLIMMHEGQIVYQADQATKSKLTVRDLLQEFANIKGATLSDKAFLG

SEQ ID NO: 5965 - protein, 321 aa, Corynebacterium glutamicum
MRQLRTTIRTQKRRSYAFGLIQNLLRDLHALALCCIFVDHVGELSCSLHRHGCWVFAVLQNTQSHLTSLAAKLGVIDTQGCQCATLNSAGLSADHRDLLLLSNLNQRRNTGNNHVVSWNVDDINIAESFNSLLNLVHGSDSLSINGQPQWLSSLGDLIDLHLRVDLTRRVDDADGLCVRNQLLQKLQLLLNRCDIRSTGDVSARCFIRIHQLCRHCIGNCGEQDWDISDILRSCLCCWSCNSQHEIQIVRSELLRNSQCSALLAVSVLLIKGDVNACLFKSFLETSGRCIKCRVLNKLVDANSVRVATCSISGGGAVTGIA

SEQ ID NO: 5966 - protein, 296 aa, Corynebacterium glutamicum
MIGAFEFGLLYGVVALGVYLTFRVLNFPDLTVDGSLTTGAATAATALMSGWPPLMATAAGFVTGFIAGMITGLLHTKGKIDGLLAGILTMIALWSVNLRIMGGANVPLLRTDNLFTPLRDAGLLGTWAGPAILAVAVGILGLIVIWFLNTDIGLSLRSTGDNGPMVQSFGVSTDFTKILTISLSNGFVGLAGALIAQYQGFADISMGIGLIVIGLASVILGQAIFGQRRVWLAVLAVIVGAIAYRLIIFAALRVGLDPNDMKAISAILVVVAMLLPRWRAKFSKAPKPKQPVAVEA

SEQ ID NO: 5967 - protein, 313 aa, Corynebacterium glutamicum
MALASCSSDSSDSSTSTDAAGGDSYRVGINQLVQHPALDAATTGFKEAFEEAGVDVTFDEQNANGEQGTALTISQQFASDNLDLVLAVATPAAQATAQNITDIPVLFTAVTDAVSAELVDSNEAPGGNVTGTSDIAPIEQQLELLQQLVPDAKSIGIVYASGEVNSQVQVDEVTKAAEPLGLSVNTQTVTTVNEIQQAVEALGDVDVIYVPTDNMVVSGISSLVQVAEQKQIPVIGAESGTVEGGALATLGIDYTELGRQTGEMALRILQDGEDPATMPVETATEFTYVINEDAAERQGVEIPQEILDKAERV

SEQ ID NO: 5968 - protein, 270 aa, Corynebacterium glutamicum
MGNTMNVSSNKPSDSDREYLQSELTRLVGQGRLDLDTYQDVVDTVWSTDDLGELMRIRARFLGGPQVSQQRPQQPPQHYGQPGYGQSPQYPPQQPPHNQPGYYPDPGPGQQQPPMHQPPTRPNQYQPGPQGGIPVGGHLPQPGAGHMPEPETSTMGSIQKSGEWLVPAYSAYKLNGADLFLDIRHATAAAPVITFDVNMTMGSMTLIVPPGVYVEVQMASKNWSDFKVQTTNPLPGAPRVFITGVARASGLKVFTKHPHEPFGFWQKMFE

SEQ ID NO: 5969 - protein, 124 aa, Corynebacterium glutamicum
MPNMQERAIHRTFGWSPSWRFLVPACALHLVVADGHPLEFHLVGQADIDLDALVAGASVVAAGQGRDRGNSRADYAEAAAVDIEVIGRSRVVHNAVAAAGAAAAKPAALPGSGHGSSSTRLDHQ

SEQ ID NO: 5970 - protein, 338 aa, Corynebacterium glutamicum
MDTQRGSLRGKAHKARLKMTPNGRRQLLLERGAAFSKNRTPGLKHVDRHTIVDSDGLSIHTYMVGHAENATATVVFIHGFTLAAEVYYMQVDYLQTFYPNIKSVLIDARGHGATGQIRPELCTIEGTANDVLAAIHEHAPTGPLILVGHSLGGLTALNLVKRADHSLRKRIVGMVLVATSIESLSTQGLPQVLASPLADNIKNAVEAAPNDAQKFRQYATTFLAPTLATAVFQRDTNDEVIDFHAAMIHETPLDTFVGFFDDLQEHDELDAAPALEGLKGYVLAGELDDVTPISQADRICEVWPGARLQIAEGAGHMLPLEAPGILNNAIGNILDGLG

SEQ ID NO: 5971 - protein, 97 aa, Corynebacterium glutamicum
MDFNDKAASENAVKTGAEGPNVFASVAKILQDVGGISAEDVTPESRFTEDLAVSSLNYIELIVNAEDAFGVRIEDADAKDLTTVQDLIDFINTNKAD

SEQ ID NO: 5972 - protein, 275 aa, Corynebacterium glutamicum
MTVNISYLTDMDGVLIKEGEIIPGADRFLQSLTDNNVEFMVLTNNSIFTPRDLSARLKTSGLDIPPERIWTSATATAHFLKSQVKEGTAYVVGESGLTTALHTAGWILTDANPEFVVLGETRTYSFEAITTAINLILGGARFICTNPDVTGPSPSGILPATGSVAALITAATGAEPYYIGKPNPVMMRSALNTIGAHSEHTVMIGDRMDTDVKSGLEAGLSTVLVRSGISDDAEIRRYPFRPTHVINSIADLADCWDDPFGDGAFHVPDEQQFTD

SEQ ID NO: 5973 - protein, 344 aa, Corynebacterium glutamicum
MAFADIVRSVENRTNAATLNWSIKNGWKPEVTGFSGYGSGRRVRVLARVLMSNPENLLVDAPSQSITQQAQRGWRQFFTIQVPNLPVTVTVGGKTVTSSTNDNGYVDLLVEDHNLDPGWHTIQIQAEGSTPAEARVLIVENTARIGLISDIDDTIMVTWLPRALLAAWNSWVLHTNTRKPVPGMNRFYEELLKDHPDAPVFYLSTGAWNTFETLQEFINKHALPDGPMLLTDWGPTPTGLFRSGQEHKKVQLRNLFIEYPDMKWILVGDDGQHDPLIYGEAVEEHPNRIAGVAIRELSPGEHVLSHGTTASLSTITTNGGQGVPVVHGRDGYELLQRYETKPFA

SEQ ID NO: 5974 - protein, 157 aa, Corynebacterium glutamicum
MRELKAVKCCRRKPNMTNNALTVPTRTRHQADLLTADFWEDMGLPQLKTTIEESIDDVALPMHTAVLEISGMPKELRQTVESAMVVCIPSPSELSGSNRDPLTARWFTAWRRDPFELGLTECREVITGTPRELDKLRGVLESLADEYRFEVELRIVD

SEQ ID NO: 5975 - protein, 275 aa, Corynebacterium glutamicum
MLRSVSMQSFKTLESWPVDNVSASVISDGAVHFYGDVDRVFELMSVTKLLATYGFLVAIEEGVFELDSPMGPEGSTVRHLLSHASGVAFDKPVAEKGVGERRIYSSAGMDILADAVAAEAEMPFAEYLREAVFEPLGMENSELWGSAGHEARSTVADLTKFGQELTAPTLISPETLAEAFQVQFPELIGTVPGYGMQKPCPWGLGFEIKGQKSPHWTGDLMPENTAGHFGQSGTFFWTVPGSGQVGVVLTDRNFGPWAKPLWTAFNDEVWAELNS

SEQ ID NO: 5976 - protein, 164 aa, Corynebacterium glutamicum
METVAEKWRILAMNQANLPAEIADLSDETALWEIINEYNWDDGFAVPLAVVRHPKCDRALALRLFWDIDETAQIHHSDEESAIAELYASTAENDPAEFDRIMDYCTTLVEGLRKQTYPRGANRFDTGFFNLEDPSLTDRQRKIRAGKTKFALKNFEEAFLQPEL

SEQ ID NO: 5977 - protein, 257 aa, Corynebacterium glutamicum
MLMTDIGDVDQIVWEFIHFHDDSINPFFEFIKSDCINDEAIERKTQILGIILGNEPCGSVIHARQNTIKPMSHTVSFGDGWIQVLEDAAETVSITDTLDALRFSPEQAEWAAEFGPLLCGPANQPPAYLTALDGHTKLPLSPQLTEFYSYARSWTNSEALGNVIDPDDYLDHLTDPRLHLQDLLDNEFERVGVLVDKQNRPLDPARCALFSLDALARAPYNRAYFVFAAPEPEIWAFENEHVHAPDLRAYLQARLST

SEQ ID NO: 5978 - protein, 182 aa, Corynebacterium glutamicum
MVGIAYARFPDTRDDSISRGKARSALEKSTGLKERFARHFPAISIPVDTGDAADILVSGWWLSGSKKKILTAAEIQTLFINRLATGPLSTQLETATGLKLQVVTNRERMKITLIEPKGTSGHAIDPQAGKGSRGGFLLDNGQEDEYDDVDTVTIPDALNVIGYILTHGTPPQEGWKVDVLER

SEQ ID NO: 5979 - protein, 155 aa, Corynebacterium glutamicum
MHIGFTPVVVFGGMSIQGFSAGDYSACFEPRIDAWVDIRGPRKPEWLAENIDNPLRHWGDNPHIPVSAAKKAGNIYKETLRTMRASTKTPDQDPLKETLRSFIASINQLAAKKNFIDAGVREDIVVALEKLCEAAEASPEEIQQAIVMGEEFIED

SEQ ID NO: 5980 - protein, 114 aa, Corynebacterium glutamicum
MSDSPCTVVILNRTATATSILRDIKALTGYGLSEIRSRIVAGLPVVIEEMFSNAWYDERAQLLLALLTKWQNEGITFEIREVAEDDPIEAGALISLEVLRNIIEPDDNESRDGI

SEQ ID NO: 5981 - protein, 520 aa, Corynebacterium glutamicum
MRSLMPQLSRRQFLQTTAVTAGLATFAGTPARAEERQFQHGVASGDPTATSAILWTRLTPIPDATPGSGLGPDSPVTWEVSPTPDFASITRSGTVITSAASDHTVHAHATGLSPSTRYFYRFISSTGEVSPVGRTQTTSLVDAPLPHLRFALASCANWEAGFFAAYGDIARRADAGELEMLIFLGDYIYEYATGMFAGKDGVVRPHQPLHETITLEHYRTRYGHYRSDNHLQAAHAALPWIVMWDDHESANNSNREGAQNHSADEGSWVDRQNAARQVFLEWMPIRQEDTLYRSFTFGDLATLSLLDLRSFRDPAPSQQQWLEGQRADTMMGSQQFEWLKSNVEHTTTTWNIIGSSVMFAPMAITGQPLFQIPEPIPANLDQWDGYSRERDRLLAVLADFATPTLFLSGDIHSEWANAIRFNGREIGVEAVCSSITSANVNDFAKLPEDNPVSLQAEQVIRANSSHVRHVDLDAHGYATVNLTQDGAHMVWHRVADLSLPDSEVAPAIALEWKPGVGFTT

SEQ ID NO: 5982 - protein, 238 aa, Corynebacterium glutamicum
MILRALTIRVVGRLMVIPHDNPRQRRMRCLQVIVTAVMAITSAVVLQRDGFMKRLMRAHHTVLSGEHTGGVLVDVITQKNQHLQFAGVSAPGDVAVGGKKSCLPIGTRRKGKAKVREGSVDKRCCLRAPHRGDLAGGGDEAVEIAGGWAQTRGVRVDGVIACCGGDYGSRARDAGEIRSGGDFPGDRRVGAKATSRCGVGNWGQPSPQNGRGCGGVPGSHAMLELAFFSACRCARKSG

SEQ ID NO: 5983 - protein, 612 aa, Corynebacterium glutamicum
MTIPGASTQTDIPLDTLLEDYALLSDTHTGALLSNMGSLDWLCLPRFDSQAMFTRLLGDREHGHWSLRVPGGEVISQNYLGDSFVVQTVWRSETGTARVVDFMPIHGQEQPDITDLVRSVHCVEGEVDVESILRLRFDYGESTPYFRTSTVDGISIVQAVAGPNAVYVRGPEMPHRPAKDCHSGTFHLTAGESVEWVLTWAPSFEPHPPMPDYTRSLESTLSFWASWVEELPHQRLYDAEVRRSMLVLRALTDLQTGGIVAAPTTSLPEDFGGIRNWDYRYVWLRDSALTIEALVEYGFSQAALQWRTWLLRAIAGDPENLRIMYGLGGERHLPERELQHLRGYENSVPVRVGNGAAEQYQADVVGEVMVALETIRRAGCLEDEFSWGMQKAILDFQEANFDRKDQGIWEMRSEPQYFTHGRAMMWAGFDRGIKAIEEFNLDGPIERWRELRAKLREEIMTNGFNEEIQSFTQCYDNTQVDASLLQLAQIGFIGFDDPKMLSTVARIEQELLDAHGFLHRYHTDGSDGLAGDEYPFLICSFWLVEQYASSNRLDEAKEKMNRILAVQSPLGLLAEEYSTHHGRLAGNYPQAFSHIGLISAARAINFEEARNR

SEQ ID NO: 5984 - protein, 80 aa, Corynebacterium glutamicum
MIQLVIGAAAGYVLGTKAGRKRYHQIKKGYEAAINSPATKSAVNAARKAIANKLDPQPRMKEVKNLRTADGHEVLEQDQD

SEQ ID NO: 5985 - protein, 225 aa, Corynebacterium glutamicum
MVMRPARRPPCVPLRAIRSSQDNHLCLWHPTAWIRVICALSVAMRRCVILWHDASRCLSSSSNRSSANTPSTPWKAVWLRFVGQSPSWRIFAIRRCSLNTPACCLVGSAGLILQRCCVRFTRKHVAPSAIRSLCVQSVSINRSRIKACDPPWRCLIRGTLCCGRNGNHSRSPCNIRSSRDRTLMDCQPIASPTLPTAWYAMPFRLLGDVNVPSMALIGCLPYRKI

SEQ ID NO: 5986 - protein, 633 aa, Corynebacterium glutamicum
MVMAKGRIPESDIQAIRERTPIEEIVGDYVQLKSAGADSLKGLSPFKDEKTPSFHVRPNRGYYHCFSTGKGGDVFSFLMEMEHISFPEAVEVCAEKIGYQINYQGGGPGRREEPGTRQRLILANKAAHQFYREQLETPEAQPGREFLLQRGFGQQHIYHFECGYAPAGWDTLTKHLLKKGFEFKELEAAGLSKMGKRGPIDQFQRRLLWPIKNLSGDVIGFGARKLFDDDKMGKYMNTPETLLYKKSKVLFGLDSAKKAIAAGHQAVVVEGYTDVMAMHAAGIDTAVASCGTAFGEEHLQMLRRLMLDDNYFRGELIYTFDGDEAGQKAAMRAFEGDQKFTGQSFVSVAPNGMDPCDLRLERGDAAVRDLVARRIPMFEFVIQSIISEYTLDTVEGRLAALRRAVPIVADIRDKTLQSEYARLLSGWVGWSDPSEVLRQVHEEARRPKRDKKPVRAKRFDQPLEDQSLRPTMALPNPRNPVLWQERESLKIALQYPELAGSYFDGLPTDSFTNPAYRMVRDAISAAGGCERALDGTDWLPAVSENMTDILGTSLVSELAMEPIEVEAQDLESYTDGVLSRLQETRVGNQIAILKGQLQRMRPSEDEQAYNSLFSDLVALEQARRELLARAFRG

SEQ ID NO: 5987 - protein, 154 aa, Corynebacterium glutamicum
MLGVIVVLAAAWFGIDLSTSGEATSQASSSATTTTITSSNTPTSESISSNSDLDGDSCSMSELPQEADEVVDDILAGGPFDYPDNDGVRFGNYEGVLPKESSNYYREYTVETPGLSHRGPLRIVTGGSNPTDPEVWYYTSDHYETFCAITDAEN

SEQ ID NO: 5988 - protein, 81 aa, Corynebacterium glutamicum
MNIVLQGSFSTRQEFFDLLGAAAWGVERPAPTNLDGMVDLIRETGLDTITVKGHWLVPAEETERIEEVCDDLGVDLRFNRR

SEQ ID NO: 5989 - protein, 212 aa, Corynebacterium glutamicum
MKMASSFLMSCASMKLFCVVSTRSSLLLVVLQLMQARLLVTPLSTGAASQPRWSWLTSSVTATQSSTRRPLLWHCPSPARPWIPSWLFATHVSRVPRLLLFVTLLDPLFHVKQMRPCTPTLALRSLWRPPRRSWLRSLLLTCLACTWLSCAATSSLMRFLPFWTACVRCLRRFSRSSMQKSRSRSLAKIWQMLSLCCSWAATLVSQLRLRVR

SEQ ID NO: 5990 - protein, 623 aa, Corynebacterium glutamicum
MCGIVGYIGQAGDSRDYFALDVVVEGLRRLEYRGYDSAGIAIHANGEISYRKKAGKVAALDAEIAKAPLPDSILGIGHTRWATHGGPTDVNAHPHVVSNGKLAVVHNGIIENFAELRSELSAKGYNFVSDTDTEVAASLLAEIYNTQANGDLTLAMQLTGQRLEGAFTLLAIHADHDDRIVAARRNSPLVIGVGEGENFLGSDVSGFIDYTRKAVELANDQVVTITADDYAITNFDGSEAVGKPFDVEWDAAAAEKGGFGSFMEKEIHDQPAAVRDTLMGRLDEDGKLVLDELRIDEAILRSVDKIVIVACGTAAYAGQVARYAIEHWCRIPTEVELAHEFRYRDPILNEKTLVVALSQSGETMDTLMAVRHAREQGAKVVAICNTVGSTLPREADASLYTYAGPEIAVASTKAFLAQITASYLLGLYLAQLRGNKFADEVSSILDSLREMPEKIQQVIDAEEQIKKLGQDMADAKSVLFLGRHVGFPVALEGALKLKEIAYLHAEGFAAGELKHGPIALVEEGQPIFVIVPSPRGRDSLHSKVVSNIQEIRARGAVTIVIAEEGDEAVNDYANFIIRIPQAPTLMQPLLSTVPLQIFACAVATAKGYNVDQPRNLAKSVTVE

SEQ ID NO: 5991 - protein, 108 aa, Corynebacterium glutamicum
MQDLFYISLSNLRFKSETVAEDLRPTKFIKFYLLGRNRLIRQITFLNPRYVSNKLNGFDPLLGNCDFWGFDPERTPDHTRVHNVLILYSGKRLRHPQTLKAKFLGSVI

SEQ ID NO: 5992 - protein, 384 aa, Corynebacterium glutamicum
MALSNPSEDFCVLVISTVFLIDTAIRICFSPRILTCSIKSSPRQVQPKALPLIRDNFWLQTRENTQGLGVALKSSTGRSNFIQRVFTVVSIRRMPNVMAQPCQIAQIRIQIQSSSDSPCNLSYFQRVRQPGARSITIIGANHLGFIREASKSSRMQHASPVAGERAAGVYGAGTQLAGLGALRLASKSVCVGIGVHLLFQPPKLLMACTPRRAQQTLDCAQRCFHLIGHPFTQEPRHVLYYYPAPLMGQGQKINYRRKLRGTIGCRGRFRVKAHASRDAHRPIRMVRISNNQHPTKLFRIKRLIGGDSVIANCRDKNQIRIHALFDQILPRDFCFGETIARKFSADSIYMLDFMKTPQLRGMPQTSSKLPRWNSIILSCAQHQN

SEQ ID NO: 5993 - protein, 424 aa, Corynebacterium glutamicum
MYPYSDADAFRRQPERAKSSQLRTSAVDTRSAFARDRARVLHSAALRRLADKTQVVGPNDGDTPRTRLTHSLEVAQIARGIGAGLDLDPDLCDLAGLCHDIGHPPYGHNGENALNEVAAACGGFEGNAQTLRILTRLEPKIVSDEGESFGLNLSRAALDAACKYPWAKTNADGSVNKKYSAYDEDAEILAWIRQGHEDLRPPIEAQVMDFSDDIAYSVHDVEDGIVSGRIDLKVLWDLVELAALADKGAAAFGGSPAELIEGAASLRELPVVAAAADFDFSLRSYAALKAMTSELVGRYVGSTIESTKKTHAGIDVGRMHGDLIIPETAASEVKLLKTLAVLYVMDDPGHLARQNRQRDRIFRVFDYLVLGAPGSLDPMYRQWFIEADSESEQIRVIVDQIASMTESRLERLARNAADISGFLG

SEQ ID NO: 5994 - protein, 225 aa, Corynebacterium glutamicum
MRRFLAKSLLLTAVVQPALRVVAYSMLRTPNNRHKIDSILVLGTAQYDGVPSRQFAARLRHAAKLWRLHEIQHVYTVGGKLPGDRFTEAEVAREYLIKEGVDPDLIFVSAVGNDTVSSYEALDPEKLGRVLIVTDPNHSYRAVRIARRMGFDAKPSPTTYSPAKFPSIVYFLTLSHEWGGVVVQDVSRLLGERVADKVEASLRAIQGLLRPSRRARHEQLRRLKK

SEQ ID NO: 5995 - protein, 679 aa, Corynebacterium glutamicum
MHLRENVRRVSVTVAIGAGALLISGPFFTAHTAEATETYVLAESPEFYQDNVTDYTGQISSSDITNIQAAIDDVKASEQKVIFVVFLSSFDGVDPETWTQQALQANGGGNVLIYALAPEERQYGIQGGTQWTDAELDAANNAAFQALSQEDWAGSALALAESVGSSSSSSSGSSSSSDFSGAWLAAAGVGTVAAGGGIWAYSRSRKKKTSAATLEDAREIDPRDTNRLMQLPMETLEHLAQEELTSTDDSIRRGKEELAIATSEFGPERTRSFNRAMNHSTGTLQKAFEIQQRLNDSIPESEAERQSMLVEIISSCGQADDALDAEAQNFADMRNLLINAGSKLDALTQKSVDLRTRLPKAQETLAGLRTRYSAEVLESIDDNVDLASASLDEAEEVLPQAYEIESMPAGEQGGLIDAIRHIEHAITTADKLLAGVEHADENISTAKANVADLIQEISDEINEAGQLKQSAGADGARADWASLDDAVRAASAALITASADAEKDPLGTYTELVDVDSALDTQLDTLRATAADQARQLRVFDQQLQSARSQIQKAEDLISTRGRIVKSEARTHLANAQKLYAMAQQNRTRDTRAGIDYGRQAAVAAQRASKSAQNDITTYNNRHNSGGGTTGAIVTGMVINSILNSGRGGGFGGGGGFGGGGGGFSGGGGGGGGFRGGRF

SEQ ID NO: 5996 - protein, 162 aa, Corynebacterium glutamicum
MVDAQRPKAGIFGSHTEETWVWLGNELFDESGEVIADVRSDVLYVDRERLLIESTPGTMRFRCRATLSGGEVYTMTQNSFTVGDLTAVCGRRTYSLKRVSPWRKERLITNNGVEVARLRPMTSGKVEFIVGTAGSEALPFVDAVFLSWACVLVDSAVRRPKI

SEQ ID NO: 5997 - protein, 194 aa, Corynebacterium glutamicum
MTSKDLIVTSYTSWGKRFKNDGKLFINLLRSTTDSADEKVLATFGEVPSKSFETTATVDEQQWELSFSIDGTATAKLPDGRVFSANAGEKTFTKSKRIEIDMDGTAMAAVNEDKNNWIIDDSEENKVAQFTGMNNGVRRAIVEFEPDVEVTQEQEIFLSWVARKTLESRMLGSSWGLTLFLIILTPIIIFLTFS

SEQ ID NO: 5998 - protein, 461 aa, Corynebacterium glutamicum
MAQQSIIDTVVNLCKRRGLVYPCGEIYGGTRSAWDYGPLGVELKENIKRQWWRSMVTSRPDVVGVDTSVILPRQVWVTSGHVEVFTDPLVESLNTHKRYRADHLLEQYEEKHGHPPVNGLADINDPETGQPGNWTEPKAFSGLLKTFLGPVDDEEGLHYLRPETAQGIFVNFKNVMNTSRMKPPFGIANIGKSFRNEITPGNFIFRTREFEQMEMEFFVKPGEDEEWHQHWIDTRLQWYINLGIKPENLRLYEHPQEKLSHYSKRTVDIEYAFNFANTKWGELEGIANRTDYDLRVHSEGSGEDLSFFDQETNERWIPFVIEPAAGLGRAMMMFLMDAYHEDEAPNSKGGVDKRVVLKLDRRLAPVKVAVLPLSKKDTLTPLAEKLAAELREFWNVDYDTSGAIGRRYRRQDEIGTPFCVTVDFDSLEDNAVTVRERDTMEQVRVPLDELQGYLAQRLIGC

SEQ ID NO: 5999 - protein, 123 aa, Corynebacterium glutamicum
MAQHSNRNFVTPAEESESTASAELQKLATAKNIKAISLLIRALDSPLRIEIILALNERPHYVHELVKLVKSSQPLVSQHLKVLKTAGIVDAERQGRQMTYSLAEPLVLDILLLALNAGVDTSG

SEQ ID NO: 6000 - protein, 144 aa, Corynebacterium glutamicum
MGINRISQGSAPKLGVRSTRQRKAVIDVLEEIDNFASAKEIHHELSTREHNVGLTTVYRTLQSLADIGAVDVLTVTGGETLYRQCHDEGHHHHLVCTNCGRTVEIDGGPVETWAQEIATKNGFALSSHEAEIFGLCADCKEKVT

SEQ ID NO: 6001 - protein, 517 aa, Corynebacterium glutamicum
MSITTHVQALTTALNAIDNHLASMLDHGVTPDQYKAIEPDLIALEHTINHHATIAAQTTALAERTNAAQSIGSTHLIDYLTTTFGLSKARAHHRINLAHSLYPIPKPNSGSGNGGNGGNPDGGPDGGDSGDDDSGDDDPDPEPDKPEDGKPDSDKPRRPRISAEKHAIITDELARLNPNTTPSAEELRTQALSQAIWRTPEDLRTWLRHQVTTANKNNPNPITAMKRRYLSVGKPDADNMVRISGLVPAATAALITANTAPLTKRGNLVDLPAAEDMRTRGQRHADALHHIMEIYNHGIVTPARGGTASIIISMTTDDLDEINHGDHGDGSLLNNLYPTNTGYSLNLAEIMNLIAAKYDFAVLLDGETGQPLNVNRMQRSANLTQRIALFASELVCSAPNCDRPQLECEVHHLDPWMRGGLTNLVNLTHQCFNHHPRNDDSRSGVNGKGFMDRDPATGRVGHYPVGGEGPVFNRSAAADSSGGAWARRKHHGPPPEPPSPPDPPGPEPDPGDEGRLF

SEQ ID NO: 6002 - protein, 264 aa, Corynebacterium glutamicum
MQSAETRSPYDDDADASRQISADERIHAEVVRGLASRGRERMSGNFRAAVFGINDGLVSNVALVMGVMATGVPAQIVLITGISGLLSGALSMAAGEYISVRSQTELLDASLPDPKAREALHALDVESNELELVYRARGMSEDEARAKASQVFQRISDQKRISDNVLGSTEIQSAGSARSAATFSFLSFAIGAFLPIVPYVFGMEGLAGAVVSLVLVGLSLMATGATTGLLSGKPPGIRAVRQLSIGYGAALVTYVLGLLFGMIL

SEQ ID NO: 6003 - protein, 243 aa, Corynebacterium glutamicum
MSEFQVPEIPAQFLPKHIALVMDGNGRWATERGMKRTEGHKRGEAVLLDVVDACIELGVPYLSAYAFSTENWRRSTDEVRFLMGFNRDVLRRQRDDLHEKGVRVRWVGRRPRLWRSVIRELETAEELTKDNTTMTLAMCVNYGGRAEIIDAARDIARLAAEGKLRPEQITEKTFPNFLDEPDMPDVDLFLRPSGEKRTSNFLLWQSAYAEMVYQDKLFPDFTQQDLYDAVLEYAKRDRRFGSA

SEQ ID NO: 6004 - protein, 242 aa, Corynebacterium glutamicum
MRRDSFRDRALVVKTYDFGEADRIIVLLTRDHGIVRGVAKGVRRSKSRFGSRLQLFVELDVQLYPGRKLSTISGADTVGYYASGIIEDFTRYSCASAILEIATHIAGLENDPHLFEETTRALKNIQDSPEPILNLDEFMLRAMNHAGWAPSLFDCAACGRPGPHNAFHPGVGGAVCLYCRPPGSAEVPPEALHMMWLVANGQAARIPREHPEQQTTIHQLTTAHLQWHIERKLPTLAVLDQA

SEQ ID NO: 6005 - protein, 305 aa, Corynebacterium glutamicum
MSFTDTPDGFRSGFVSFVGRPNTGKSTLTNALVGEKIAITANQPETTRHPIRGLVHRDNAQIIVVDTPGLHRPRTLLGERLNEAVKDTYADVDLIGFTVPANEKIGPGDRWILEAVRKVSPKTPILGIITKADSVSRDLVAAQLMAVHELLGGNSEVVPVSSTSGENVETLIKVMTDLLPEGPKFYPDDHITDEDTNTRIAEAIREAALSGLKNELPHSVAVEVDEILPDPERNGVLAVHAIIYVERVGQKDIIVGHKGQRLGRIIHTSRQDIIKILGQNVFLDLRIKVLKNWQSDPKALNRLGF

SEQ ID NO: 6006 - protein, 440 aa, Corynebacterium glutamicum
MESSVIWLSIATVVALLFSGLLGAVESALSSVSRARVEQMLKDEASGSASLLRVIDERALHINMLIMLRTLLDASAAVFAGAIAVNVMDSWAWGIVLAIVVVSLLTFAVVGVFGRTVGRKNPYSVMLRSAVVLSGLAKILGPIARGLIWIGNIIAPGPGFRNGPYATEVELREMVDIAQEHGIVEIEERRMIQSVFDLASTTVRQVMVPRPEMIWIESGKTAGQATALCVRSGHSRIPVIGENVDDIIGIVYLKDLVQKTYYATDGGKSVLVDEVMREATFVPDSKSLDALLQEMQEDHKHIAILVDEYGGVAGLISIEDILEEIVGEIADEYDAREVAPIEKIGDRTYRVVSRLSLEDLKDHIEEELDLEIEFGDEIEDQVDTVGGLIAFELGRVPLPGATVETCGLKLTAEGAKNRRGRLRMHSAVVEVGEPSEDNEG

SEQ ID NO: 6007 - protein, 196 aa, Corynebacterium glutamicum
MSIEVFNESGYDGVNEEMLIDVLSFALGEMDIHPDAEASIHIVDVDTIADLHVKWLDLEGPTDVMSFPMDELTPGYSRPDGATPGPAMLGDIVLCPEFAAKQATKAGHDLAHELALLTVHGSLHLLGYDHVDPAEEREMFALQNELLADWYDNVEARGVTYQPKPSGAGAFPTAADRLELDEKMEADDSGFGGVES

SEQ ID NO: 6008 - protein, 88 aa, Corynebacterium glutamicum
MCPTSWWRTTSDEVSSEKCTSSTPRRMWRTRRRPDFWPPGRSTWVMSPVTTILEPNPRRVRNIFICAGVVFWASSRITNASLRVRPRM

SEQ ID NO: 6009 - protein, 350 aa, Corynebacterium glutamicum
MNIPKAGRTSTVTAPRKTRTEVITTVLNLERTLAQTVLGINDENLRVLDNQIDCDIHVRGTHVELTGPAHEVSRASKIFEELQAIARRGHVISPETVKNVISMINVETPQTVSEILTGDILARRGKVIRPKTLGQKHYVDAIDTNTIVFGLGPAGSGKTYLAMAKAVQALQSKQVSRIILTRPAVEAGEKLGFLPGTLNEKIDPYLRPLHDALRDMVEPEVIPKLMEAGIVEVAPLAYMRGRTLNDAFVILDEAQNTTPAQMKMFLTRLGFGSKMVVTGDITQVDLPGGQKSGLRLVRHILRGVDDVHFSELTSSDVVRHQLVGHIVDAYEDYEEREARELKRKRQETRP

SEQ ID NO: 6010 - protein, 241 aa, Corynebacterium glutamicum
MSLPVFISDSAAGPGETIELAGPEGRHAVTVKRIQVGEKISLIDGRGTARTCTVTALQGKDRLNAVVDLVEEIPAPNPQVTIVQAIPKSERSELTIDLLTQAGADRIVAWQASRCVAKWGGKEAKSLAKWQVAAEAAAKQSRRATIPEILGVVGEEGVEKLIDESDLAIILHEEATAAIRELEFSGNVVVIIGPEGGVAPSEISRFVDAGAHTVKLGPEVLRTASAGMVALAAIGVLSDRW

SEQ ID NO: 6011 - protein, 314 aa, Corynebacterium glutamicum
MRHEVAVAFCAQLRHAFTIQGDHIVGLSTCRDGNFHLFAGEGFHVQFGAKRCIEHWNLDAGVQIVAIAGEDGVRAHHDFNVEVTRRTATSANLTLACHADAHAGLDASWDVGHDVAASTHTTISCTLSARIWDDLTGAIAGVAWAGRHDVAQEAALHFLNFTSAITGATGNRLLVGCRSRTMTLGTQHCGVKGEIFLSALVSLFQGDGGAPQGVTAWLHAGTWSTGTARATAEEGIEDIAQSTAAAEASTEATSASSAALLHWVTAHINNAALIRISEYLMRNRSLAEFLRCFLTWVYVRVVFAGKLSVCLFDL

SEQ ID NO: 6012 - protein, 382 aa, Corynebacterium glutamicum
MARDYYGILGVDRNATESEIKKAYRKLARKYHPDVNPGEEAAEKFREASVAHEVLTDPDKRRIVDMGGDPMEQGGGAGAGGFGGGFGGSGGLGDIFDAFFGGGAGGSRGPRSRVQPGSDTLWRTSITLEEAYKGAKKDLTLDTAVLCTKCHGSGSASDKKPVTCGTCNGAGEIQEVQRSFLGNVMTSRPCHTCDGTGEIIPDPCTECAGDGRVRARRDIVANIPAGIQSGMRIRMAGQGEVGAGGGPAGDLYIEVMVRPHAIFTRDGDDLHASIKVPMFDAALGTELDVESLTGEEVKITIPAGTQPNDVITLDGEGMPKLRAEGHGNLMAHVDLFVPTDLDDRTRELLEEIRNHRSDNASVHREGGEESGFFDKLRNKFRK

SEQ ID NO: 6013 - protein, 341 aa, Corynebacterium glutamicum
MSATEKRRYEVLRAIVADYIASQEPVGSKSLLERHKLNVSSATIRNDMSVLESDGFIVQEHASSGRVPTERGYRLFVDSIHDIKPLSLAERRAILGFLEGGVDLEDVLRRSVQLLSQLTHQAAVVQLPTLKTARVKHCEVVPLSPMRLLLVLITDTGRVDQRNVELEEPLAAEEVNVLRDLLNGALGEKTLTAASDALEELAQQAPTDIRDAMRRCCDVLVNTLVDQPSDRLILAGTSNLTRLSRETSASLPMVLEALEEQVVMLKLLSNVTDLDQVRVHIGGENEDIELRSATVITTGYGSQGSALGGLGVVGPTYMDYSGTISKVSAVAKYVGRVLAGE

SEQ ID NO: 6014 - protein, 330 aa, Corynebacterium glutamicum
MASLDNPRQAETIFIGGGTPSLIGADGLARVLGAVRNTFGIADGAEVTTESNPESTSPEFFDGLREAGYNRISLGMQSASSSVLKVLDRTHTPGRPVAAAKEAREAGFEHVNLDMIYGTPTETDDDVRKTLDAVLEANVDHVSAYSLIVEDGTAMARKVRKGELPAPDEDVYADRFELIDARLRSAGFDWYEVSNWAKPGGECKHNMGYWVDGDWWGAGPGAHSHIGDRRFYNIKHPARYSAQIAAGELPIKETERLTAEDHHTERVMLGLRLKQGVPLNLFAPAARPVIDRHIAGGLLHVNALGNLAVTDAGRLLADGIIADILLSEED

SEQ ID NO: 6015 - protein, 173 aa, Corynebacterium glutamicum
MQGMKRKMVAAALATALLFGAAPAHASELVEPTTVAESVALDPNKAINILTPDLWEDIEAKPGDIVHIPYQGTRNYEDLTVEVAKPFEDFQILVGLDNSIVIAVPKNLSGAASVAPVFTVSDKNGEIDSFTIKVSVEPRRQSDEEKRSALFDVISELAYRMPHLPFVSELLKY

SEQ ID NO: 6016 - protein, 231 aa, Corynebacterium glutamicum
MCWNAMSSTTAQLRHRELTQEIYNIGDEVAEYIEHIMEAVSDWDLELVEDCLAEFDEIITEARDDSRTVVAELSGLRHALTTGIRQGTVSARATVEVDVDKPERLTASELERDFDIDAGLVDVRDLSTALNARTDAVVKRLEATVEWVLAETDKVANDLDSLSLPLLYGRVAAVIESATSAWINAVGTANPAYVRTMRGSNPPRFLLERARIDAVVARVADKLAQKRNAVS

SEQ ID NO: 6017 - protein, 126 aa, Corynebacterium glutamicum
MSNTETQFDWDGSTWTRTEVGEAPTRFAVGVMEDFAYIAATGTDGDEEFFTLGSNPGLTFGDPEWLFAQDNPQYVVECIGQQGTEPAALKVVDKYLSRLSDEESRGEPTRILNELVSAMELPALPW

SEQ ID NO: 6018 - protein, 615 aa, Corynebacterium glutamicum
MTSPNTLQEYTEPAKYTIGESETCLTALLDQIKTRPYGVLFSKPANYEWVNVTAKEFQDEVFAVAKGIISVGVEQGDRVALLSNTRYEWAVLDFAIWAAGAVSVPIYSSSSLSQIEWIIEDSGAVLAITETPDHTDLMKNLVIGEDGTPAIKGSPSKLRRILEINSSALETLKFEGRELSDELVWERIHATKAADLASLVYTSGTTGRPKGCELSHYHWLAEVRALITNDIGAIAMPGSRLLTFLPLAHVLARAVHLAFAVTGATQSHWSDFSTLTLELQRSRPNLILGVPRVFEKVRNAAAANAADGGAIKRIMFERAEKAAIEYSMALDTAEGPSKSQVMAHKAFDKLVYSKIRAAVGGDVQYAITGGSAMGQELLHFFRGVGMTIYEGYGLTESAAAAAVDFTDQKIGTVGKPMGGMTIKINEDGEIMLKGEMLFQGYWNNPEATAEALHDGWFNTGDLGELLESGHLVITGRKKDLIVTAGGKNVSPGPMEDIIRAHPLVSQAMVVGDGKPFVGLLVTLDPDMLKRWKLNHNIAESRTVSEIATDPALRAEIQDAVNNANATVSHSEAIKRFYILDRDLTEEADELTPTLKVKRNVVVRRYADAIDHIYNR

SEQ ID NO: 6019 - protein, 706 aa, Corynebacterium glutamicum
MTARRFLNELADLYGVATSYTDYKGAHIEVSDDTLVKILRALGVNLDTSNLPNDDAIQRQIALFHDREFTRPLPPSVVAVEGDELVFPVHVHDGSPADVHIELEDGTQRDVSQVENWTAPREIDGIRWGEASFKIPGDLPLGWHKLHLKSNERSAECGLIITPARLSTADKYLDSPRSGVMAQIYSVRSTLSWGMGDFNDLGNLASVVAQDGADFLLINPMHAAEPLPPTEDSPYLPTTRRFINPIYIRVEDIPEFNQLEIDLRDDIAEMAAEFRERNLTSDIIERNDVYAAKLQVLRAIFEMPRSSEREANFVSFVQREGQGLIDFATWCADRETAQSESVHGTEPDRDELTMFYMWLQWLCDEQLAAAQKRAVDAGMSIGIMADLAVGVHPGGADAQNLSHVLAPDASVGAPPDGYNQQGQDWSQPPWHPVRLAEEGYIPWRNLLRTVLRHSGGIRVDHVLGLFRLFVMPRMQSPATGTYIRFDHNALVGILALEAELAGAVVIGEDLGTFEPWVQDALAQRGIMGTSILWFEHSPSQPGPRRQEEYRPLALTTVTTHDLPPTAGYLEGEHIALRERLGVLNTDPAAELAEDLQWQAEILDVAASANALPAREYVGLERDQRGELAELLEGLHTFVAKTPSALTCVCLVDMVGEKRAQNQPGTTRDMYPNWCIPLCDSEGNSVLIESLRENELYHRVAKASKRD

SEQ ID NO: 6020 - protein, 621 aa, Corynebacterium glutamicum
MRLLGRILKTTSALWPYYLGIIVVSIVIAALSLLSPFILREATDSIVSAVTGSNTVDAVTRTIIFLALALFVASFLNTVMTNIGGYIGDVMASRMRQILATRYYAKLLALPQKYFDNQVTGTIIARLDRSINGITQFMQSFSNNFFPMLITMVAVLIISAIFYWPLAILLAMLFPIYMWLTALTSKRWQKYEGEKNHEIDVANGRFAEVVGQVKVVKSFVAETRELADFGGRYGKTVAITRPQSGWWHRMDTLRGAALNIIFLAIHLLIFYRTLHGHFTIGDMVMLIQLVTMAQQPVYMMSYIVDSAQRAIAGSRDYFEVMAQQVEPTANKELVDATLASDTPRISVGTPAALPAGEPAMEFKNVTFAYEEGKPVISDVSITARHGERIALVGESGGGKSTLVNLLLGLYKPNSGSLAVCGVDVKDLTSEELRASVGVVFQDASLFSGSIAENIAYGRPGATREEIIEVAKKANAHEFISAFPEGYETVVGERGLKLSGGQKQRVSVARAMLKDAPLLVLDEATSALDTKSEQAVQAGLEQLMENRTTLMIAHRLSTIAGVDTIVTIQNGRVEEVGSPTELAVSGGIYSELLRLTNSTAEADRERLRAFGFTGDAPAEEED

SEQ ID NO: 6021 - protein, 85 aa, Corynebacterium glutamicum
MFSAIDPENKLASWKTTPTDARSSSEVRSLTSTPHTARLPLFGLYRPNRRLTRVDLPPPDSPTNAMRSPWRAVMDTSEITGLPSS

SEQ ID NO: 6022 - protein, 111 aa, Corynebacterium glutamicum
MVTMVSTPAMVDRRWAIIKVVRFSISCSKPAWTACSDLVSSAEVASSRTRSGASLSMARATETRCFWPPESLSPRSPTTVSYPSGKAEMNSCALAFLATSMISSRVAPGRP

SEQ ID NO: 6023 - protein, 60 aa, Corynebacterium glutamicum
MEHHNPPERDKNHTMANPEELRKRDQELPKRKRKYPQSRVTQALVVLLVIVVIAWLVSLI

SEQ ID NO: 6024 - protein, 68 aa, Corynebacterium glutamicum
MTAFLDRISQLLTTSPLWIQSPIVILGSVVVCALLAVLLLRVVDILGAWVQRIGTPQSSGKGQEPHHG

SEQ ID NO: 6025 - protein, 678 aa, Corynebacterium glutamicum
MTVEHLLKPSTLPYQLPDFAAIKVADFPPAFELALAEHDAEITAIATNEDAPTWENTIEALERAGLSLNRVAAVFFNLQGTDSSPEMDEIAATIAPKLSAHSDAIFHNAALFARIEAVEAPADEESQRLLSHTKRAFRRRGAALNADGKARLSTINQRLSALSEQFGRNLLQDTRDLAVNFEESELAGFSEARISAAADYAAAVGTEGYVVPLELPTVQSEQAVLTESASRAKLYEASQKRGASLNKDVLLETVRLRAERATLLGYDTHADYVIEEETADDVAAVRALLYDLAPAASANAKAEYKLSAEEAEEHGQKVGAADWSFWEAKVRARDYALDETELRNYFPLNQVLRDGVFFAANRLYGITVEPRPDLRGYAEGVDVWEVLDSDGSGIGLILTDYYGRPSKRGGAWMSSFVDQSELLGTKPVVVNVMGITKPTTGEALLSLDEVTTIFHEFGHGLHGLLSKVRYPSFSGTSVPRDYVEFPSQINENWAFDPAVVRNYARHVDTGDIIPDSLLEAVEASRQFGQGFATSEYLAASIIDLAWHSLSTAEAAAVNDIDQFEADALAAAGLDVDNIAPRYRSTYFNHIFAGGYSAGYYSYLWAEALDADGFDWFREEGAAGSVASLDAARTAGQKFRDLVLSRGAASDYSNAFEELRGRSKDLGPLLRRRGLAGAI

SEQ ID NO: 6026 - protein, 393 aa, Corynebacterium glutamicum
MSATSSVTVECPAGTITGEPHYFRSIPYAKARPFADAEKLEPLRIDATGKHEGLYLTLATPEARFGADAPVIVYIHGGGYDGGTRFDARTEPTFFREQGFVVVSIDYRVGLEGFARFHDDEANRYRGIDDCVLALEWVQKNIEHFGGDPTNVTLIGQSAGAGIALWLTRLDHYKGAFRRLVALSPSFPRQPFAARKGALRRALGKPVTRASLAGIKPARLDKGYRRFARRYFTDLALGPTPYDPNELADIDLIISSTRDEMYGHRAGLWFDQRGFGAKLAARLFGLENSDTYIKEARKIDNRVVGRMIGDAVIRRYVAQTEKGWWMEFPGKHCDDLSLVFLEDSEAHHHIASFARGATPSWPQYSEENRAALSLVSGEAKVVKDPLRMVRLAF

SEQ ID NO: 6027 - protein, 598 aa, Corynebacterium glutamicum
MNSQPSADHHPDHAARPVLDAHGLIVEHESEEFPVPAPAPGEQPWEKKNREWYKDAVFYEVLVRAFYDPEGNGVGSLKGLTEKLDYIQWLGVDCIWIPPFYDSPLRDGGYDIRNFREILPEFGTVDDFVELVDHAHRRGLRVITDLVMNHTSDQHAWFQESRRDPTGPYGDFYVWSDDPTLYNEARIIFVDTEESNWTYDPVRGQYFWHRFFSHQPDLNYDNPAVQEAMLDVLRFWLDLGLDGFRLDAVPYLFEREGTNGENLKETHDFLKLCRSVIEKEYPGRILLAEANQWPQDVVEYFGEKDKGDECHMAFHFPLMPRIFMGVRQGSRTPISEILANTPEIPKTAQWGIFLRNHDELTLEMVSDEERSYMYSQFASEPRMRANVGIRRRLSPLLEGDRNQLELLHGLLLSLPGSPVLYYGDEIGMGDNIWLHDRDGVRTPMQWSNDRNGGFSKADPERLYLPAIQNDQYGYAQVNVESQLNRENSLLRWLRNQILIRKQYRAFGAGTYREVSSTNESVLTFLREHKGQTILCVNNMSKYPQAVSLDLREFAGHTPREMSGGQLFPTIAEREWIVTLAPHGFFWFDLTADEKDDME

SEQ ID NO: 6028 - protein, 363 aa, Corynebacterium glutamicum
MSIGQHIITERFYGAKSHTIDNVDIVLSRECGENTLAVVRINNALYQLLVNDDGKDVLNDHVEEVGASFGAWTGSSAFPIGPFTPLGTEQSNSSFITADNKAIVKYFRKLESGQNPDVELISKISSCPNIAPILGFSSAEISGANYTLVMAQQYVPGLDGWSHALTTTSGSFAEDAEKIGEATRNVHTALASAFPTRVVPVEALADALTTRLNELISQAPEIARFKEAAIDLYQSLEGEAHIQRIHGDLHLGQLIKTPERYILIDFEGEPARPLNQRRLPDSPLKDLAGIIRSIDYAAYFDGEHTQWANEATALFLDGYGSIEDQELLNAYILDKALYEVAYEINNRPDWVKIPLEAVERLLD

SEQ ID NO: 6029 - protein, 195 aa, Corynebacterium glutamicum
MSKLRGMTTEVELVVLADSEGNPIGTAPKATVHTKDTPLHFAFSTYILNPRGELLVTRRALSKKTWPGVWTNSMCGHPGPDETNADAIRRRGVDELGLEVDSFLDIQEILPDYQYRAVDASGIVEWELCPVHLVRLAVGEFVEPLDDEVEEFEWAEPQKLFDAVDATPFVFSPWLVDQLSAPELRQAILEAFDAE

SEQ ID NO: 6030 - protein, 74 aa, Corynebacterium glutamicum
MRSSSTADVTVFTLPVFFCPPPAPPMGIMGIIGIMPRPKLLIDGFPLPDPTIPRPEPDCELDPTDDPVWRAYLL

SEQ ID NO: 6031 - protein, 146 aa, Corynebacterium glutamicum
MNRCIRRDTARIGDTTLRSPRRSQPRRRPCLPTASNLIHPQSNFPRRTIRPLHLHQIAHRRHTRQHIRLKSSLKRRQKRPLRSKPLHRIQNRLNRRRSHKHLHAMPHINPIQRPHRRPHHFRIRSKRRPRSRHLINPSSSLLKRFA

SEQ ID NO: 6032 - protein, 585 aa, Corynebacterium glutamicum
MTLKIDPSSISSAVSRLNELQHQAITASQVGMKSTILSAFSPVSGLDQLGSGHGNVINGGAGAANSVLNSYAEQIEWLSAALQASGAALTGQDELFARGMDVADTGGRVVEESVMFPARPAPRFESFVFNPPAVSPSLSLDALCSQFSGTNSGAVLEAQGSWGSMASAISNVSASLSSIAGEILAENSGETFEQAAARINEVAAAGATFAANAKMMGASVGTLNRIYMGHRMQVFMAATSIKAILDPVQRLAAERAFLASFQATFQADVLTGMPPVSNLMQMKGANGSAGEIALGMDEIAGSGQAWSAAGLTPSGAAQGGVANAGSIAPDAAVQGAAGQSGVGSFGTVTDQLDGINIGDMLTSAASAGQSLANGLAMPTSTPNSASGAIPSSMSAASPLGAFGSGAGLGAQGGSIGSSAPGAISSRAAGSAGGSVPGMTGGPGAPGITSDSLMGARTHGASSAGAVAPMMGGAGGMSGGVVGAGGTGSQSKYARQTGSSVGSSSQSGSGLGMVGSGSGKPSISNFGRGMMPMMPMMPMGGAGGGQKNTGKVKTVTSAVEEDRNLAALLGDRGPVVPGVIGDWVRG

SEQ ID NO: 6033 - protein, 220 aa, Corynebacterium glutamicum
MNFREPTPNFCSLTLMSAFSRPSLRLQRSGYFMRRIWLLVCGIALTVAGCTSGSTTPTTVTVTATPTSEEAASTEPTNDILASQFHPCEVLTQEQFEEVGLGVLIVEDAYLGSTGLGCSFGKADREDFSGTWLISTDQANRQFVENQDLETLDWGSNDNPDLYVHQMSETGRQCEAAVDYDWGRLTVDYLELGEGWEPEILCSDAVEILENLIKELRGIP

SEQ ID NO: 6034 - protein, 173 aa, Corynebacterium glutamicum
MKLRTIPALLAVALLAGCSGESADSQAVSAEETMEVTTTSTPVFEAKEVSPITVPSGDIRVEDPGLNVEFIFRGTRYGTNGGSIIHIAVKNLNDVALPADAIDPPTLDIEDYNGNKTNIETLSGDDNIPLDLPLGAGATTNLQYAFNTSNGSLSNAKFQIGNVIYSGNLNSLA

SEQ ID NO: 6035 - protein, 325 aa, Corynebacterium glutamicum
MADAVEREVFGYPPDATGLNDALTGFYERRYGFGPNPESVFAIPDVVRGLKLAIEHFTKPGSAIIVPLPAYPPFIELPKVTGRQAIYIDAHEYDLKEIEKAFADGAGSLLFCNPHNPLGTVFSEEYIRELTDIAAKYDARIIVDEIHAPLVYEGTHVVAAGVSENAANTCITITATSKAWNTAGLKCAQIFFSNEADVKAWKNLSDITRDGVSILGLIAAETVYNEGEEFLDESIQILKDNRDFAAAELEKLGVKVYAPDSTYLMWLDFAGTKIEEAPSKILREEGKVMLNDGAAFGGFTTCARLNFACSRETLEEGLRRIASVL

SEQ ID NO: 6036 - protein, 426 aa, Corynebacterium glutamicum
MSKKSVLITSLMLFSMFFGAGNLIFPPMLGLSAGTNYLPAILGFLATSVLLPVLAIIAVVLSGENVKDMASRGGKIFGLVFPIAAYLSIGAFYALPRTGAVSYSTAVGVDNALYSGLFNFVFFAVALALSWNPNGIADKLGKWLTPALLTLIVVLVVLSVAKLDGTPGEPSSAYAQQPAGAGLLEGYMTMDAIAALAFGIVVISAFKYQKVNKVRTATVVSAFIAGILLALVYLGLGSIGQVVNGEFADGTAILNYAALSTMGQAGRIMFVAILILACMTTAVGLISATSEFFNSLLPGVKYHVWATVFALISFGVATMGLDTVLAVAAPVISFIYPSAITLVFLSLIEPLLFRLKWTYLFGIWTAVVWALFMSIPALNPFIEWAPLHSMSLGWVVPVLVASAIGLAIDWNKKGAQSVAKKESISV

SEQ ID NO: 6037 - protein, 326 aa, Corynebacterium glutamicum
MSIPLSLIDFATIFEGERPGDSFKRSVALAQKAEGLGFKRIWYAEHHNMESISSAAPAVLISHIGANTKTIRLGAGGVMLPNHSPYVIAEQFGTLAELYPDRIDLGLGRAPGTDMNTLRALRRDPQSAENFPSDVVELNSYLTGRSRLPGVNAIPGKGTNVPLYILGSSLFGAQLAAQLGMPYSFASHFAPTHLEHAVQTYRDNYQPSEQHPEPYVIAAVNVTASDSTEQAHDDFYKVARARVKNMALRGRQVTDEQLDELMDSPAARQIVDMLHYTAIGTGSEVKEYLDGFVKTAQADELMISLQSPNTEATTRNMEILADAWIN

SEQ ID NO: 6038 - protein, 174 aa, Corynebacterium glutamicum
MVMNAVKVRTGVPALMRSKAMFTCILFVLMCAPFLLFFLIALQSAEGTMHTLYLVAATLPGCGIVAAIGSMCVVWGRRRQAVLIVDDQVRIPGSGISFAIEELDTVQLWSDLKSGSYMALLPHHIKERANVTGVHSVQPYIVNFPSGAQPQPFELAEILLSEKPELNLDRLGRL

SEQ ID NO: 6039 - protein, 309 aa, Corynebacterium glutamicum
MQQVLMGFTVVFIVIGIGWILGRRDTLGTHAQKPLSLFVYYVATPALLFDRVTKSDTSTIFSLNFVVIALSALIVGFLFFLLMRFVIKRTAAVSVIGMLAASYANAGNLGIPLAAYILDDFTVVIPVILFQVAFYAPITMTIMEMLTNKKSTNLVRNLLVTPLTNTMVLAAIAGIAVSLTSMSVPVVIAQPVEMLANASVPLALVVFGLSLSKSKILEKGQVSRRDVFTAALFKNVLHPIVAGLLALAFGMEGTALLSAVILGALPTAQNVYTYALRFRTAESMARDTGVVTTLISFPVLVAVSIIFGS

SEQ ID NO: 6040 - protein, 948 aa, Corynebacterium glutamicum
MTHTIKFNRLDPEVFSQHSRAKLRTDMTTRAAYSSDAGIFRRVPAAVAEPENVEQIRDAIAVAVARGWSVVGRGGGSSVAGNAIGEGLIIDTSRYFNRILDIDPVAQTAVVEPGVVCDALRDAAAEFGLTYGPDPSTHSRCTIGGMVANNACGSHSVAFGTAAENLVDVTLMLSDGREVTVTKDGCDDAEINQKLTDLASKNQDLISKELGRFPRQVSGYGLHYLAHDMAKAMAGTEGTIGIITRLTVKLVPTPKVKALAVLAFDTVFDAARAAAKLRLPGVATIEGMGGDLLAALRSKQGQSEAGQNLPGNRIGIEAGGWLYCETGSDTLQAAVQAAEEVATAVDTIDYVVVSEPSEMRELWRIRESSAGIVTRLADGGEAWPNWEDSAVPPENLADYLRDLYALMDKFDYQGIPFGHFGEGCVHVRISFDFSTKEGLKKFEAFMNEASTLVASYGGSLSGEHGDGRARSSFLDRMYSAEMRALFEEFKLIFDPQRIFNPGVLVWADPVMQGLRMDPGQRALDITPVHKFSKDKGSMINAVNRCVGVSACRSESDAMCPSFQITGDEVHSTRGRARLLSEMFRGESIADGYRSEEVNEALDLCLSCKACASECPVNVDMSTYKAEFLDKHYAGRLRPMAHYVMGWLPLLGHVAHKIPLLPTLIDATMQSALTAPVVRKVGGLADRPLISFAHRSLRKYKPKKNSGETVVLWPDSFNTNLDTGPAHAAIKTLEALGYNVVIPDGFVCCGLTWHSTGQLSMTKKVLEQTAKVMKPYLDQGLTVVGLEPSCTVMLQDEATELSDNPDLARLAALTKPFAEVIAPKITELVESGSLQLTESTALTQVHCHERSLGDPQQSALVLEALGVKDEQIATGCCGLAGNWGFEKDHAEMSFALGERELFPKVRKAEGHVIADGFSCRTQIEQGTGKQATHLAEVVLSILEQNNMAQ

SEQ ID NO: 6041 - protein, 237 aa, Corynebacterium glutamicum
MPTKRVAPARSLTDQVMDFVRESTLDKTMVTGEWYSVYQVSDQLGISRSPVRDALLRLEEAGLIRFTRNRGFQIVETKPSDVAEIFALRLGIEPAAAYRAAQLRTEEQLHEADDIIALMAQAEADNDEEAFFTHDRQFHRQIMTMGHSQRGADLVEKLRAHTRILGASTAGNKRTLGDILEEHEPILDAIKRQSAEMARATMREHIQVTGKLLLEQAVEKSGEGAAQKIWDQYTAGV

SEQ ID NO: 6042 - protein, 94 aa, Corynebacterium glutamicum
MFLRVKGVKMNSIFKLFSVLFAVFLVAFLIGGTLIVGVQTVGVILLSEDLVTGATRNIAPWAFGSATLCAVCAFVLRYRPGRPTGSDTVQHEID

SEQ ID NO: 6043 - protein, 449 aa, Corynebacterium glutamicum
MGIIALLVFIAIAVILNVFLKRDISEALLVGLVGTALVGGVNAPTLLIDAVVDAAQSEVTFAGMAFVFMGIVVQSTGLIDRLIAILNSIFGRLRGGAGYVSTLGSALIGLIAGSTAGNSATVGSVTIPWMKKTGWTAERSATLVAGNSGLGVALPPNSTMFIILALPAAAASSASQVYIALACGGAYAVLYRLAVVFYWTRKDKIPATPDDQRVSFGEAMKTGWRSPLIFLGILIPVILTIGPLSEWLKTHGVGESGVKSMSIIVWVPILITAIALIEGRKRIANNMAHFRVQISKDLPQFATVGISLFSALAAANIMEELGVGPQLSNWLDSMDLPKSVMVIIVCIMCIVVATPLSSTATAAAIGAPAVAALAAVGIDPTVAIVVILLCTSTEGASPPVGAPIYLSAAIADANPTKMFVPLITYFVVPMILLAWLVGMGFLPVIVPTG

SEQ ID NO: 6044 - protein, 141 aa, Corynebacterium glutamicum
MPSSLLQWRLSEGGVHIPFGHLADTVSWDCGGGSCATNDLVSLFMPAAFMSTLAACVFGAWAIGLIAPALFIAVTAWAFRSGVQAAIADGYTSATSVGFEMTVSLILFIIAGLCFLGWIPMFINNRQVARKVRERAAGLSN

SEQ ID NO: 6045 - protein, 503 aa, Corynebacterium glutamicum
MKITRGLLPSLLLASTIVVSSCSAGSTAYQQPPAVDQSSIVIATTAAAASLDFTNAAGAAIPQAMMSNIYEGLVRIDAEGEIQPLLATSWDISDDRTEYIFHLREGVLFSNGDPFNADSAKFSIDRVKTDWTNGLKSGMDVVESTEVIDDHTLKVSLVRPSNQWLWSMGTAIGAMMTEGGVDKLATDPVGTGPYTVTHWAPGRAIGFGARADYWGQKPLNDAATIRYFSDATASTNALQSGDVDVIWAMQAPEQLATLQEYTVEVGTTNGEMLLSMNNQRAPFDDVRVRQAVMFAIDRQAVIDTALEGYGTDTGGVPVPPTDPWYEKSTMYPYDPDRARALLEEAGAEGTRITMSIPSLPYAQAASEILYSQLRDVGFDPVIESTEFPAVWLAQVMGQKDYDMSLIAHVEPRDIPTLFSPNYYLGFDDTETQALLAEADSSANEVELMQQAVDRIMEQAVADNLMNVANIVVMSPEITGIDPNVVSGALELSLIGRKESGVAQ

SEQ ID NO: 6046 - protein, 322 aa, Corynebacterium glutamicum
MSKTIAWTVLRYTLTFVIASIIIFVLIRVIPGDPAAVALGITATPEAIAALQSQLGTDQPLFQQYFSWIGGMLTGDFGTSLSSGQDLSPIIFDRLQVSLILVGCSIVLSLLIAIPLGVLSARRGGVIISGISQIGIAIPSFLAGILLVAVFAVGLGWLPANGWIPPSENFGGFLARLILPVLALTAVQAAILTRYVRSAVMDVMGQDFMRTARSKGMSFNRALIIHGLRNAALPVLTVTGLQLTTLVIGAVVIEQVFVIPGIGSMLLESVSNRDLIAVQSIVMLLVAFTLLVNLVVDLLYQVVDPRVGAVGVASTKVPGSVA

SEQ ID NO: 6047 - protein, 276 aa, Corynebacterium glutamicum
MTTIKNMPLSGKIGGFIVAVVFVLAALSFIWTPFDPVQAFPQERLEGSSLRHLLGTDRYGRDVLSQIMVGSRVTLLVGIIAVAIAALIGTPLGIAAGMRRGMVETFVMRGADLMLAFPALLLAIISGAVFGASTWSAMVAIGIAGIPSFARVARAGTLQVTSQDFIAAARLSKVSSARIALRHILPNITSMLIVQASVAFALAILAEAALSFLGLGTTPPDPSWGRMLQTAQASIGVTPMLAVWPGAAIALTVLGFNLFGDGLRDAIDPKREVGRA

SEQ ID NO: 6048 - protein, 479 aa, Corynebacterium glutamicum
MLKVSDLTVGNNFVHNVSFEVNPGERVGIIGESGSGKSLTALSIMGLTDLPTTGQITFNGKPSATFRGTRIAMVFQEPMSALNPLMRIGRQIEEMMTLHGASKKDARARLKSLLIDVSLPERTASAYPHELSGGQRQRALIAMALANDPDLLICDEPTTALDVVVQKQIVDLLLRLTKERGTALLFITHDLGLIARTCERLLVMKSGETVERGDTEAILRSPAHSYTQQLLDASILDQPEIASDSGAPVVIDVEEASKSFKETTALHKVSLAVRKGDLLGIVGGSGSGKTTLLKLIAGLDKPTTGTVAVTGGVQMVFQDPQSSLNPRMKIKDIVAEPLLGWNAAEKTTRVAEVITQVGLSPDVLDRYPHEFSGGQRQRISIARALAIKPAILLADEPVSALDVSVRKQVLDLLQQLVEEYGITLVFVSHDLAVVRHLCTTVWVMEQGRVLEQGPIDSVYDHPQTEYTKELLDAVPRLSL

SEQ ID NO: 6049 - protein, 169 aa, Corynebacterium glutamicum
MSFSRVVLPEPDPPTIPSRSPLRTANETLWRAVVSLKLFDASSTSITTGAPESEAISGWSRIEASRSCWVYEWAGERRIASVSPRSTVSPDFITNKRSQVRAMSPRSWVMNNKAVPRSLVRRSSRSTICFCTTTSKAVVGSSQINRSGSLASAIAISARWRCPPESSCG

SEQ ID NO: 6050 - protein, 183 aa, Corynebacterium glutamicum
MRLFASITPPIEVTEHLINALRPYKDDLRWSDPDNWHITLAFYGELPDGAVEDLIEHLTSAARINEEFTIRIKGAGSFNRKNLWMGVGGDTKDLRRLMADCLIDPEERRRQRAHLTVAKPTQRQRSRDWDPVIPDLVHALSIYEGPEWPVDEIELVSSEPGKGRSGGPLYTTVATIALSSALV

SEQ ID NO: 6051 - protein, 301 aa, Corynebacterium glutamicum
MNNRIVVVGSINADLNVLVDRHPAPGETLLGSGGHITAGGKGANQAVAAALQGADVAFVGAVGKDPYAAPALEFLRSSGVDLTAVSEVDDTTGLAVITVAKDGENNIVVIPGANSLVNCDYVSSQSALLAEAGILLLQGEIPADGFKEAIHHTMGRVVVNLAPVIEVEKSALLEADPIIANEHEAGLILDQFGAGIDSMDPHELAQALLDAGFASVVLTLGSAGALVADATGITDIATPTVQAVDTTGAGDAFAGAFCARLIKGDSLIDAATHAARVGAYSVQTAGAQASYPDASVSLPSV

SEQ ID NO: 6052 - protein, 475 aa, Corynebacterium glutamicum
MRSVLDYWIMTLAPSTNAVSQQTRRNPSQAPRLLHRLHFFAGIICAPLIFIAALTGLVYAFSPTIESISNQEMLTVSKSASDTALPVREQVSIAQELHPDLDLSGVRLGDDSSTTRVLFADETLAESTVRAVFVDPYTGEITGDTTQYGSSAALPFRQWVSQGHRMLWLGEPGRIYSELAASWLGVLAVGGFALLWLRNKKPGRLRKMVRTGGRGRVKTYRRHAALGTVAGLGFVFLTFTGLTWSTYAGSNITDLRTQLNWTQPSVNASLTAAPQVDMHDEHAGHHMHMESATSGSGSIDLVAATAISELRTPLTITPPAQDGLAWTATENRDAYRFTTDTIAVDGDTGMLTNRLNSTDWPLAAQASAWLIQLHMGTLFGLPNQVVLGLLAASIIVMIGLGYWMLWQHRPREGWPSAPKRAGFEKPTWGTIALGVVVIAYGLLAPLFAVSLLVFIGLSLGVRFISRMSGRADTSN

SEQ ID NO: 6053 - protein, 101 aa, Corynebacterium glutamicum
MDVSARPDIREINRTPRLNPINTSSETAKSGARSPYAITTTPNAIVPQVGFSNPARLGALGQPSRGRCCHSIQYPRPIITIIEAANSPSTTWLGRPNRVPM

SEQ ID NO: 6054 - protein, 324 aa, Corynebacterium glutamicum
MSKTEEGRSAAIIIYAFPTFILLGAIIAFIFPEPFIPLTNYINIFLTIIMFTMGLTLTVPDFQMVLKRPLPILIGVVAQFVIMPFLAIVVAKMFNLNPALAVGLLMLGSVPGGTSSNVIAFLARGDVALSVTMTSVSTIVSPIMTPFLMLMLAGTETAVDGGGMAWTLVQTVLLPVIIGLVLRVFLNKWIDKILPILPYLSILGIGGVVFGAVAANAERLVSVGLIVFVAVIVHNVLGYVVGYLTGRVFKFPEAANRTMAIEIGTQSAGLASGMAGRFFTPEAALPGAVAALVHNITGAVYVGLVRNRPLTKASRKKESVAVSS

SEQ ID NO: 6055 - protein, 282 aa, Corynebacterium glutamicum
MCELSYLNAVVMLKAQRGGNSGLYFGSMTTFITSGGLEISPAGAHIVHAESPEGELLFVSSASQYGEGNAIRGGVPIIAPWFGGLLGLDPAHGWAKRSAWDVTEHDGQIHAEYGRDGLLLDIRANSTKNGFEITLRAYNDTDEARTVQLAFHPYFKVDDVEKIEVRGLDGVDILNRLNNEVETQDGPVTFDGEFDRIALGTPVVRIFDTDRIITIEGDGHDSTVVWNPGESRASTVADIGEGEWRDFVCVEPALLGADQKGVRVAPGQSVTVGMQVSVEKRA

SEQ ID NO: 6056 - protein, 122 aa, Corynebacterium glutamicum
MFGDVIRLSDHRHQQKGFANFTKSLPPPNPDFYLGHTFETYGTLRCLHFPISEHLPSTSVLATPPPTFSAKPELCKLHNRGDHPRTKLKNPNRLTHQCPMEQCVNHATTQTDAHHVETVTVH

SEQ ID NO: 6057 - protein, 190 aa, Corynebacterium glutamicum
MSISRTVFGIAATAALSAALVACSPPHQQDSPVQRTNEILTTSQNPTSASSTSTSSATTTSSAPVEEDVEIVVSPAALVDGEQVTFEISGLDPEGGYYAAICDSVANPGNPVPSCTGEMADFTSQAWLSNSQPGATVEIAEDGTATVELEATATGTGLDCTTQACVAKVFGDHTEGFRDVAEVPVTFAAA

SEQ ID NO: 6058 - protein, 196 aa, Corynebacterium glutamicum
MTDMWFSSDLHLGHKFVASMRGFDDPDEHDEVILSNFENTIGPDDVLWILGDLSSGAHRAEERALGLIAERLGGVVKHLVPGNHDSCHPMYRHAYKRQRRFLEVFDSVQAFQRMKWDDEDVYLSHFPRPGQDHPGMESRFDDLRLRVPLLIHGHLHSQFPMTGPGQVDVGVEAWGLKPAPRELVQLKLWESLSEKI

SEQ ID NO: 6059 - protein, 630 aa, Corynebacterium glutamicum
MSTNSGNNLPESQESPEEPHYPHDTHPGLVPGISVDAQRNKFGLDKTVFGVTAALILAFIAWGISSPDSVSSVSSTMFSWAMTNTGWLLNFVMLIGIGTMLYIAFSRYGRIKLGTDEDEPEFSRFSWIAMMFGAGIGVGIFFFGPSEPLWHYLSPPPHTVEGSTPESLHQALAQSHFHWGLSAWGLYALVGGALAYSSYRRGRVTLISSTFRSLFGEKTEGIAGRLIDMMAIIATLFGTAATLGLSAIQVGQGVQIISGASEITNNILIAIIAILTIGFIISSVSGVSKGIRYLSNLNISLTLGLVLFVFITGPTLFLLNLIPSSVLEYGSEFLSMAGKSLSWGEETIEFQAGWTAFYWAWWIAWTPFVGMFIARISRGRTLREFALITMAIPSFILILAFTIFGGTAITMNRENVDGFDGSSSKEQVLFDMFSNLPLYSITPFILIFVLAVFFVTSADSASVVMGTMSSQGNPAPNKLIVVFWGLCMMGIAVVMLLTGGESALTGLQNLTILIAIPFALVLIVMAIAFIKDLSTDPAAIRQRYAKAAISNAVVRGLEEHGDDFELSIEPAEEGRGAGATFDSTADHITDWYQRTDEEGNDVDYDFTTGKWADGWTPESTEEGEVDAKKD

SEQ ID NO: 6060 - protein, 332 aa, Corynebacterium glutamicum
MNDFETTIDRISKEQDPAARSRVEQFIVETVRALPNLTTKQGASLAIQLLDAVQLADAAGTKGGASTSNASSLPDTFDALTSLIGKLDVRSDSEWRSFGFQPSETAHPLMIAIPEIEIFYQHTDVEPGSDDAVAPDFQENQDMWRRRLGSVTEPNLIYKEFSGPGKAQRAVEMLGNLWKIGVVVSRNTESRLGLTRVEYTPTPGEVPVPLMSEKNCWYSIRVSETIGENQVPEIVRCLGEIFCGYLPQMWLKEPVKAGKLRIQESEAAAYIAMARLDLSPRTGNTTWTNSYISTRPLSPAFRWDVVLEASHQLENLLRGDTGPVTATQSAAG

SEQ ID NO: 6061 - protein, 536 aa, Corynebacterium glutamicum
MKVVEVKKRNLLVAPLTASLVFCNLAVAANAVEVEAESPVVINEVESNSDPVGDWVELANTDNNNSIDISGWSLVDDKEDLENALVLPEGTEIESGGYFVIYTDSADYVPTNNTFGGQEYFGLGKDDTVTLRNAEGEVVATYSWKDLGEHAENTYGRIPDMTGDFANTGVPTPGAKNVAAEGSGEEEGVVANAQLPFHNVEITPIHLGGDFTGEDMSGVDFDANSTAWIANNDIGKIYSLAHDIANNTYKLTGEWETGYPEGGGEPDAEGIVAATNGDIYLSTERNNADKNVSRPSILRFATPTGKTGVQNAVQEWDLSEFVGDIQPNGGLEAIAQLEDNIFVVGVEETGDVIVVDLSADQPVLVQRYESSFDGVMSLDYNAATKQLSVVCDEACDGLSEILEWDGEKLYKSDDKIYERPANLGNWANEGFGTYTSELKCENGNTVSVTSYLWADDAATNEGTSLNSAQVINGDCGDVNIPGESSSDNSSSDFATGSIAGAFATAVLAVVGIAGALGGFFQQILAAFPALQQVIRF

SEQ ID NO: 6062 - protein, 128 aa, Corynebacterium glutamicum
MPPSFFPRRRKSEPDLLALPAQIRDVHADVLDIFMAESLVIINIDEKSAKLLIDAARHHIPTRFTGPNARPLSVIPIEDPRSRPTLHPDHGWMMPLSPPVVDELLGGGLKIGETELESTNIAFIVDAS

SEQ ID NO: 6063 - protein, 437 aa, Corynebacterium glutamicum
MLSPAAVAALILVIGIVVLIIASVPVAIAIGLPSLFAAMAVLGPENAAQAVAQRMFTGTNSFTLLAIPFFVLAGLLMNSGGIATRLIDAAKVLVGRMPASMANTNIAANGLFGAVSGAAVASASAVGTVMTPKMKEEGYSRAYAAAVNVASAPAGMLIPPSNTFIVYSLVSSTSIAALFMAGVGPGLLWILACVIVGTWLARKENYKREQIHPTFKQSLVVLWRALPSLLMIVIVVGGILLGWFTPTESAAIAVVYCLVLGFIYRTIKVGDLADILLKATRTTSIVMLLIAVSAALSWVMAFAKIPQMISDALLSVSDSKVVILLIMMFILLLIGTVMDPTPAILIFVPIFLPVVTELGVDPVHFGAMVVMNLSVGVITPPVGNVLFVGSQVAGLRVETVIRRLWPYLIAIIVALFVVVFVPQISIWLPTTMGLMGG

SEQ ID NO: 6064 - protein, 160 aa, Corynebacterium glutamicum
MFSRQVLHSPSTWSEELSKLLFVWLSFAGSAFLFGERGHIAVDFIARKLPVSAQRVLQVIVQLLIVVFAILGMIWGGYLAASIAWNQQLTALPLTLGWVYVVIPIAGVFIALFAIIDLIEVATGKEEPYPLVDESEEPRDLDELEAQSAIDSASSAEGRN

SEQ ID NO: 6065 - protein, 249 aa, Corynebacterium glutamicum
MWGSVEKRKYLRSFDWFTTPEVGVIGSIEHQMSVIRDQDLMEPLFQSLAESDNISVIGGFTQGTRNLYTTDAPVKRPADLAGKKIRVQESAMHIRMIELMGGSATPLTYGEVYTAMQSGVLDGAENNEISYVTQNHFEVARYNSNTNHLVGLDYMVMRHDLLDAMSEPDRELFLEEWDAAMTEHTDLWNTETDAVIEKAKAGGAEFVEVDAQAFTDALAPIKDEFLTSEFQRELYEAVRAADTSGGAAS

SEQ ID NO: 6066 - protein, 81 aa, Corynebacterium glutamicum
MPVLPDTRNTSSGSQPTMLAISNAYLSGSAAGRSILFSTGMISRSFSIAKYKFAKVWASMPCAASTSKIAPSHASSARDTS

SEQ ID NO: 6067 - protein, 615 aa, Corynebacterium glutamicum
MAEKFAETTFTDPARIRNFCIIAHIDHGKSTLADRILQLSNVVDARDMRDQYLDNMDIERERGITIKAQNVRLPWIPRSGEYEGQQIVMQMIDTPGHVDFTYEVSRALEACEGAILLVDAAQGIEAQTLANLYLAMENDLEIIPVLNKIDLPAADPDKYALEIANIVGCEPEDVLRVSGKTGMGVPELLDKVVELIPAPTSEFEEDAPARAMIFDSVYDTYRGVVTYIRMMDGKLTPRQKIKMMSTGATHELLEIGIVSPTPKKCVGLGPGEVGYLITGVKDVRQSKVGDTVTWAIHGAEQPLRGYQEPTPMVYSGLFPISQADFPDLRDALEKLQLNDASLTYEPETSVALGFGFRCGFLGLLHMEITRDRLEREFGLDLISTAPSVNYRVIDEAGKEFRVHNPSDWPGGKLSEVYEPIVKVTIIVPSEFVGPTMELCQTKRGQMGGMDYLSEDRVELRYTMPLGEIIFDFFDMLKSRTKGYASLNYEEAGEQTADLVKVDILLQGEPVDAFSAIVHRDNAQWYGNKMTVKLKELIPRQQFEVPVQAAIGSKVIARENIRALRKDVLAKCYGGDISRKRKLLEKQKAGKKRMKNIGSVEVPQEAFVAALSTDEA

SEQ ID NO: 6068 - protein, 203 aa, Corynebacterium glutamicum
MSSTLARKASGDGSEKKKPGLFRRALRFLTHPPHKQVDNSLADIREGLGLGVDDSHEGSKPSNDHSLLHEKPEISVMPTESMARLIFYAPDMDGQTDPGEVVWIWAPADGPQQPPRKRAIVVVGRNRNAILGLLISCNPEHRTDEDWIDIGSGSWDPRGRQSWVRLDRVLEVPELGIRRQGTVVPPGRFERIANRLRNDFNWV

SEQ ID NO: 6069 - protein, 87 aa, Corynebacterium glutamicum
MANIKSQIKRNKTNEKARLRNQAVRSAVRTEIRKFNAAIEAGDKDAAQAQLRTASRALDKAVTKGVFHINNAANKKSNMATAFNKLG

SEQ ID NO: 6070 - protein, 223 aa, Corynebacterium glutamicum
MEWTAFGTLILLNLVGSLSPGPDTFFLLRLATRSRAHAIAGVAGIVTGLTVWVTLTVVGAAALLTTYPSILGIIQLVGGTYLSFIGYKLLRSASRELIDARQFRFNADARPIPDAVEALGTRTQVYRQGLATNLSNPKVVMYFAAILAPLMPAHPSPVLAFSIIVAILVQTFVTFSAVCLIVSTERVRKAMLRAGPWFDLLAGVVFLVVGVTLLYEGLTGLLG

SEQ ID NO: 6071 - protein, 135 aa, Corynebacterium glutamicum
MSMTQSDLPDDVQELVTKIFGLARDGGAESAATLGAYVDNGVDVNLSNQDGNTLLMLAAYAGHADVVQALIERGADVDRVNNRNQTPLAGAIFKKEEAVIEALLAGGADPYAGTPTAVDTAKMFGREDLVARFES

SEQ ID NO: 6072 - protein, 325 aa, Corynebacterium glutamicum
MASAPISVQPAVHLVLGEDEFLAERARINIVHDIRSSMASPDSLQVTTLKASEITQGELLDALSPSLFAEDRVVVLTNMDQAGQDAVDLALSAAVDPSPGTYLIVMHSGGGRSKSMVKKLEKVAVVHDAAKLKDRDRPGWVKQEFKNHKVQVTPDVIHALLEGVGSDLRELASAVSQLVEDTQGNVTVEKVRAYYVGVAEVSGFDIADSACAGQMSKAVASTRRALQLGTSPVALAAALSMKVGQIARLYSTRGRINGFELAKELGMPPFVVEKTAKVARNWSGDAVSEAVILMADLDAAVKGQSGDPEFAIESAVRRVAELARR

SEQ ID NO: 6073 - protein, 513 aa, Corynebacterium glutamicum
MFKHWGQAVVIAALGVGAVVMAALRISSAKAFEAPQTWVGTAETIKFLDSGDQLIGLRVEGYPAPIPVFYSGSDTIEKASLIAVSGRIKPDSFPGVGDLTISTEDIDQLEPTTGYSAWVNQVRDGFSQAVEETVGESSRGLIPGMVLGDTRLQGSIEAQTYIDTGLSHLSAVSGSNVAIVVSSVVVLSYFLTAGPRIRVVASLLSLVIFVSLVGFEPSVLRASVTGIVGLLAIINSSRMEPMHGLSLSVICLLFYDSNLAVHYGFLLSCAATAGIVMLQPLLYRAIGPPLAVWKVPDIVVRAFAVSIAADLVTIPIIALMARQISLVAVLANVLVELAVPPITLLGLIAVLASLLPWPVEYPLLKIIEPFTWWIHHVAKWCQQLPNSTLEISAGWAGIAWACMAAVWVVVIIYKGYVRTLAVCCVCFFLFGAWNNRLPAQIDPTELRFVIIADDSELTDVPEHAELIIVEDPHGSMSDRPIVTREGIPVLYPYRDGEVSLHIDGTQHAADGRF

SEQ ID NO: 6074 - protein, 194 aa, Corynebacterium glutamicum
MNYPTPRFQISIKHALIVCIVLVVAFVGWFFTREKPVNPPTMAALAETYQTPAPSSQVVVSVVGHVAKPGLVTLAEGSRVADALAIAGALPDADLTALNLAQLLVDGTQIHVLAIGEVQPISVDAAATSASGLISLNTATVADLVTLPGVGEKTAQAIIDFRESNGGFSTVEDLLQVKGIGPSKFEQISGLVSP

SEQ ID NO: 6075 - protein, 274 aa, Corynebacterium glutamicum
MQRKHTVIATAFKLAGVTCCKFQRRQPGCTAFFTVIHHVQVNHRDVEVLGHMRWQACGGINNYPNWHRLYSSTFLLPSSLLRNTHVPAVKIPLGVFHIVALKMRAVGNRRRNLEVIFWVLTTCIIARSGGQLCPTGISKSREHGVLIIRQVQKIRGQRINRATVSHDEHGAFIPIIKRHHQLVDNLACPARNIHARFAAGWCPLRIVAPLSARTWIFGIHLSVGFGLPLTQMRFPKTLIDAHLRVNQRRNRACGVEGAGKIRAEHMGDVFLNQH

SEQ ID NO: 6076 - protein, 274 aa, Corynebacterium glutamicum
MPVRVIVDSSACLPTHVAEDLDITVINLHVMNNGEERSTSGLSSLELAASYARQLERGGDDGVLALHISKELSSTWSAAVTAAAVFDDDSVRVVDTSSLGMAVGAAAMAAARMAKDGASLQECYDIAVDTLKRSETWIYLHRIDEIWKSGRISTATAMVSTALATRPIMRFNGGRMEIAAKTRTQSKAFAKLVELAQIRADGEPVFIAIGQNEAREAAKQLEELLRNALPEGSSFMSVDIDPTLAVHSGPGAVSVSAVFANQAPELSTGKAGAK

SEQ ID NO: 6077 - protein, 236 aa, Corynebacterium glutamicum
MTRRLILLRHGQTEYNATSRMQGQLDTELSDLGFQQAASAASVLVQKNITHVFSSDLSRAFNTASAVAALIDAEVRVDKRLRETHLGEWQAKTHTEVDSEYPGARAQWRHDPQWAPPGGESRVDVARRARQVVDELMVSLDDWDEGTVLIVAHGGTINALTSNLLDLAYDQYPMFSGLGNTCWAQLTARPRYYAGSENPEDDLKISSAVSNSPHFEGNNVENAQWYLDGWNMGVTQ

SEQ ID NO: 6078 - protein, 157 aa, Corynebacterium glutamicum
MSALEESIRIATIAAKAADEKKADDIAVIDVSDMIAITDCFVVASADNERQVGAIVEEIEDEMTKAGFEPKRREGNRENRWVLLDYGLVVIHVQRQAEREFYGLDRLYRDCPLIEIEGLETFKRESSWSDEADIRNIDSIDELPPLPAEYEPGYEDD

SEQ ID NO: 6079 - protein, 226 aa, Corynebacterium glutamicum
MRTLYCPLMTTTVKRRARIGIMGGTFDPIHNGHLVAGSEVADRFDLDLVVYVPTGQPWQKANKKVSPAEDRYLMTVIATASNPRFMVSRVDIDRGGDTYTIDTLQDLSKQYPDAQLYFITGADALAQIVTWRDWEKTFELAHFVGVTRPGYELDGNIIPEMHQDRVSLVDIPAMAISSTDCRERSSEERPVWYLVPDGVVQYIAKRQLYRPEGSDKDMDPKGQNQA

SEQ ID NO: 6080 - protein, 341 aa, Corynebacterium glutamicum
MSVTNFRRFLAGIAVIAACVAATPTAQAQSSGSSGSSGSSAGSSGLWDLLFPESHESFIERLLDPLDDSHISIHPDLTPDLYEEVFDPPQIGECPAVVAVVARGSEQNLQIRPARYSEESPWTSNGFEEKNFRSFFGRMEKHYRESTGESLMKDVYVMGLNNIEYPASLPLSSEGSSAIELGTSISSGRDNVISAIDRFESATGCTPKYLLAGYSQGVLIVDGYEEELIARDQYLGTLHIANPAQQVDDPTLVGHEVTTGGLASSVEPVEDNPFKVSYCLPGDIVCDRSFEQFSAAGSSIAAAQLSTGNIRPGRVHVQYFVTTQPWDEQIFDEVASWIEAA

SEQ ID NO: 6081 - protein, 432 aa, Corynebacterium glutamicum
MSSTTLTDDQIRDNERTEVLAKATAAKNIVPDIAVLGTGPKNAILRAAADELVARSAEIIEANASDIEAGRANGMEESMIDRLALDESRIEGIAGGLRQVAGLTDPVGEVLRGHVMENGIQMKQVRVPLGVMGMVYEARPNVTVDAFGLALKSGNVALLRGSSTAVHSNTKLVEILQDVLERFELPRETVQLLPCQTRGSVQDLITARGLVDVVIPRGGAGLINAVVTGATVPTIETGTGNCHFYIDAEAKLDQAIAMVINGKTRRCSVCNATETALLDAALSDSDKLAVVQALQEAGVTIHGRVAELEAFGATDVVEATETDWDSEYLSFDIAVAVVDGVDGALAHIAKYSTKHTEAIATQNIETAQRFADRVDAAAVMINASTAYTDGEQYGMGAEIGISTQKLHARGPMALPELTSTKWILQGTGQIRP

SEQ ID NO: 6082 - protein, 304 aa, Corynebacterium glutamicum
MKFVMYPHLWESTTAVIEGGGHERVEDIKDADFIFFNGSAPEFPDLPENIKFVQASMAGIDALVKRGVVNEKARWANAAGLYADTVAESTIGLILAQMHMHATTRLAKSWSVRPEVENNKSWLHDNKTVAILGAGGIGVRLLEMLKPFNVKTIAVNNSGRPVEGADETFAMDKAEHVWAEADVFVLILPLTDATYQIVNAETLGKMKPSAVVVNVGRGPLINTDDLVDALNNGTIAGAALDVTDPEPLPDSHPLWEMDNVVITPHTANTNERIRALTGELTLRNIELFEAGEQMATEVDVVAGY

SEQ ID NO: 6083 - protein, 237 aa, Corynebacterium glutamicum
MIWPAGPKISTISPCWKSPMISVMPTASKDLPPEVTASTAPSSSRIFPAVSAAYKAQNFHAERRLSLGWNTVPTWASSSAGPMFAAEVNSTGTPLREAKRAADTFDAMPPVPTFPPSPAMTPFKSLPSRTSEINFAVGSVGFLSKSPSTSLSSTKASADTRCATIAASRSLSPKFTPVVATVSFSLTIGTAPKMRSLSMVRCAFLARSRFPASAAVRSTWPMGRPYRAKERPHWCMR

SEQ ID NO: 6084 - protein, 501 aa, Corynebacterium glutamicum
MNRFIDRVVLHLAAGDGGNGCVSVHREKFKPLGGPDGGNGGHGGDIILEVTAQVHTLLDFHFHPHVKAERGANGAGDHRNGARGKDLVLEVPPGTVVLNEKGETLADLTSVGMKFIAAAGGNGGLGNAALASKARKAPGFALIGEPGEAHDLILELKSMADVGLVGFPSAGKSSLISVMSAAKPKIGDYPFTTLQPNLGVVNVGHETFTMADVPGLIPGASEGKGLGLDFLRHIERTSVLVHVVDTATMDPGRDPISDIEALEAELAAYQSALDEDTGLGDLSQRPRLVVLNKADVPEAEELAEFLKEDIEKQFGWPVFIISAVARKGLDPLKYKLLEIVQDARKKRPKEKAESVIIKPKAVDHRTKGQFQIKPDPEVQGGFIITGEKPERWILQTDFENDEAVGYLADRLAKLGIEDGLRKAGAHVGANVTIGGISFEWEPMTTAGDDPVLTGRGTDVRLEQTSRISAAERKRASQVRRGLIDELDYGEDQEASRERWEG

SEQ ID NO: 6085 - protein, 629 aa, Corynebacterium glutamicum
MPPAPKLAALGLQHVLAFYAGAVIVPLLIAQSLNLDTATTIHLINADLLTCGIATLIQSVGIGRHIGVRLPIVQGVTTTAVAPIIAIGLGVTDGQGGVASLPAIYGAVIVSGIFTFFAAPVFARFLKFFPPVVTGTVLLVMGASLLSVSANDFVNYADGVPAARDLAYGFGTLAVIILAQRFFRGFMGTLAVLIGLVGGTAVALILGDANLDEVGNAEAFDITTPFYFGVPEFNAVAIFSMIIVMIITMVETTGDVFATGEIVGKRTRRSDVTRALRADGLSTLMGGVMNSFPYTCFAQNVGLVRITGVKSRWVAAAAAGFMIILGVLPKAGAIVASIPSPVLGGASLALFANVAWVGIQTIAKSDLADSRNSVIVTSALGLAMLVSFRPDVAQAFPEWARIFVSSGMSVGAITAILLNLLFFHVGRQSGGQVATSKSGERINLDAVNKMDRTDFVETFAPLFNSKTWPLETAWESQPFANVTELREAIQVAVLTAPLSDREELIHDYPDMAQLILATEEEAATISQDRGSIGLDDLDDVDQEKLITVTEQYRERFNMPYVAYFDTMDSVDTVVAAGLRRLDNSDEQEHRQALSEIIEIANDRFDILLADANPARSAFDRKFTETDFLG

SEQ ID NO: 6086 - protein, 281 aa, Corynebacterium glutamicum
MDQKNKLSKSEGIPLVTLNDGKTIPQLGFGVFKVDPDEAERVVTEALEVGYRHIDTAAIYGNEEGVGRAIAKSGIPREELFITTKLWNDRHLDVEAAFEESLQKLGLDYVDLYLVHWPAPKNDNYVAAWKGLEKLGDRARSIGVCNFLPEHLEKLLAEATTVPAINQIELHPALQQRDAVEASLAAGITVESWGPLGQGRFDLGAEEPIAAAAKNHGKTPAQVVIRWHLQNGFVVFPKTVTKSRMVENIDVFDFELSDEEMAAITALERNDRGGSHPNDLN

SEQ ID NO: 6087 - protein, 207 aa, Corynebacterium glutamicum
MSYDFVLFETDGDPGSARISKTPLTERIDFATPSTTPVLESLSAGLAETVPDTVKLEEDAIHLSGDRCLYVVTNYNSAEEAAEWLTAIAFDYGLGLADMNADTILLFGDEDSDAVVQIDDWFSPAFSAYGLPHLLVEVMRLKDSKTPYLRVTLAADDSKFIQTLYETDNKQWLVETSSSTGTDETHVKTINDVLERIETWFNQETAV

SEQ ID NO: 6088 - protein, 132 aa, Corynebacterium glutamicum
MLYITQSPQKNPKNKKLPLTFPKGKQGAVLNSLSECDLSVNSLGLDDVHQATVALGGKLDSASLQCEESVVATATNILTWVELGAALTNKDLACGNLLTTETLDAKALSLGITTVAGARCTLLVCHVVIPSF

SEQ ID NO: 6089 - protein, 88 aa, Corynebacterium glutamicum
MAHKKGASSSSNGRDSEAKRLGVKRFGGQQVSAGEILVRQRGTKFHPGENVGRGGDDTLFALKTGAVQFSTKRNRRLVNIVETEAVDA

SEQ ID NO: 6090 - protein, 101 aa, Corynebacterium glutamicum
MYAIVKTGGKQYKVAEGDLVKVEKIEGEPGASVALTPVLLVDGADVTTAADKLASVSVNTEIVEHTKGPKIKILKYKNKTGYKKRQGHRQPLTVLKVTGIK

SEQ ID NO: 6091 - protein, 756 aa, Corynebacterium glutamicum
MERRMIVRERQRHDHPGLVTQVGVLEDDQLVEQFVTSDAQMSMVGNIYLGRVQNVLPSMEAAFIDIGKGRNGVLYAGEVDWKAAGLGGRGRRIEQALKAGDQVLVQVSKDPLGHKGARLTTQISLAGRYLVYVPGGRSAGISRKLPGPERKRLKEILGRVVPAQGGTIIRTAAEGVSEENIAADVNRLHTLWEQIKERTAEEKKSRGSKPITMYEEPDMLVKVIRDLFNEDFTSLIVDGDRAWNTVRAYIQSVAPDLVSRVEHFNRADFDGKDAFEAFDLNTQLEEALSRKVNLPSGGSLIIDRTEAMTVIDVNTGRYTGKGGGNLEETVTLNNIEAAEEIVRQMRLRDLGGMIVVDFIDMVLPENQELVLRRLNEALENDRTRHQVSEVTSLGLVQMTRKRIGAGLLETFSSPCEHCEGRGIIVHVDPVDTVDERVEAKAEERSRRHQRSNSTNKAAAEHPMVVAMRDLVESDEHDLDQEFEELAASVIVLDDSDLDDVVNDKLDEPERILAESTVEPEEGPRRRARRQRQESAADDIAAIAAAAVDIASEEDPDEPSGSSYVSDFEAEPIAPVVEKAAEPVAEPTADYEKARAEFEASPRRRRKTRGNSRSDHAPKPEDFAPVVEEVAETPVKTPARKAPRRNRPSELSSGAPSSAPSTRNRRRAVRRQLVEAPETVVEIAPEAAPEQVAEPQVEFDQPDNRRKRRRAVRVTAAPVEKKVASTSNARAPKKEPQAASTTNPGRRRRATRRGPRS

SEQ ID NO: 6092 - protein, 183 aa, Corynebacterium glutamicum
MNSWVLTTWRRFLFSSRISVRRRRCASKRVEPLIPIGSFTSSTSLVDASSLTSVTVSASAPRPRPVPRRPRRFRAVRSRTCSSSVSWTFSVGTTAGATKIGVYTDASTGAGVISGTISSSSSAVASSRAAASKSVGCATAASSRSTFSSIWWISFSTFFSTRRRIFSTGSTSGTAAGAALSTG

SEQ ID NO: 6093 - protein, 191 aa, Corynebacterium glutamicum
MAAFFVFFAHFRATAALRLQASGALNSDWLVYLFYFACRRLLTHFGDGFSFSSTSAAGATTPTALPRRAFADLFIVGVLDVFSRYNCRCHKDRRVHRCFHRRRGDLWDDIFQQFCSGFFAGCRLEVSRLRDCREFALYFFFDLVDFIFHILLNASTNLLHRFNVGDGSWGSVEYGLRQGVEKLFYFFFAQV

SEQ ID NO: 6094 - protein, 249 aa, Corynebacterium glutamicum
MSEIMGDLAKHMGSEPPAWWKFLPMIVLAGATRVTYEVEPWLAIPLFILAFASILIPFPISKTKGLRDIDAWKIHTTQGDKKRAIRQLIIPATALAIDIIGLPTLFNAPPLASAALFGGVYGASLAWAAYRADQLPRIRTKERLAELSQNASLDDVRSDDLDVLEQPESRELVRCLLAHGAMDGTRVMARQVARVLDTEVDEVHQVARSLEQHGLVSRSTIMPGGDPGKVFIEVSLKGISAIKALESGR

SEQ ID NO: 6095 - protein, 203 aa, Corynebacterium glutamicum
MSNAEINPVEYEINNHAPGTALNPQCEDGANVEIITSREVPLGGPRAMTVHRTLPQRQRSLIGAWCFVDHYGPDDVSLTGGMDMASHPHTGLQTVTWLFEGEVTHHDSGGNHAVVLPGEVNLMTAGAGICHTEVSATSTTILHGLQLWTVLPDKDREGPRRFDHYAPEEITLEGGSARVFLGSLFGQTSPVHTFTGSSCFRVH

SEQ ID NO: 6096 - protein, 436 aa, Corynebacterium glutamicum
MKSTGNIIADTICRTAELGLTITGASDAGDYTLIEADALNYTSTCPECSQPGVFRHHTHRMLIDLPIVGFPTKLFIRLPRYRCTNPTCKQKYFQAELSCADHGKKVTHRVTRWILQRLAIDRMSVHATAKALGLGWDLTCQLALDMCRELVYNDPHHLDGVYVIGVDEHKWSHNRAKHGDGFVTVIVDMTGHRYDSRCPARLLDVVPGRSADALRSWLGSRGEQFRNQIRIVSMDGFQGYATASKELIPSARRVMDPFHVVRLAGDKLTACRQRLQREKYQRRGLSQDPLYKNRKTLLTTHKWLSPRQQESLEQLWAYDKDYGALKLAWLAYQAIIDCYQMGNKREAKKKMRTIIDQLRVLKGPNKELAQLGRSLFKRLGDVLAYFDVGVSNGPVEAINGRLEHLRGIALGFRNLNHYILRCLIHSGQLVHKINAL

SEQ ID NO: 6097 - protein, 126 aa, Corynebacterium glutamicum
MLVDSGDVQLEGVTVEPTQLAYTGINETQLRIRNIGTTPARTVLLGGEPFTEDIVMWWNFIGRSHEEIAEYRKQWQAEADRFGITHGYISHHKDGLTRLPAPELPNAAIKARKNPAPTARPETRID

SEQ ID NO: 6098 - protein, 150 aa, Corynebacterium glutamicum
MRSAHGPYIDKFFPEPYKNMLELTKTLRKIYPDVDLPTSLIELVNVRVSQINGCGTCLSLHVPAARRAGVPEKKLDALAAWQMVDEFTVEEKAALQLAESLTLLESREGHLAARTACSVFAEEQVAALEWAIIAINAFNRISIASGHPLL

SEQ ID NO: 6099 - protein, 136 aa, Corynebacterium glutamicum
MTERTLILIKPDGVTNGHVGEIIARIERKGLKLAALDLRVADRETAEKHYEEHADKPFFGELVEFITSAPLIAGIVEGERAIDAWRQLAGGTDPVAKATPGTIRGDFALTVGENVVHGSDSPESAEREISIWFPNL

SEQ ID NO: 6100 - protein, 120 aa, Corynebacterium glutamicum
MGGGVIKVVVALRTMRNSKSGLAFSAAALFCVVAVITRIAGSPSFIAIVAIIVAAIALFVGLNSRVGTKLVDQPVVFTQEQIDQLKELKSRDQEAAAIRQAQLWSRGSSSEAVAEAVRKL

SEQ ID NO: 6101 - protein, 114 aa, Corynebacterium glutamicum
MTLKDKYDTEVAVSNNQDKHQFEVSYPEDAVTAGFAAYLDKGDSRIFYHTVVGDEFGGKGLASILVSEALKATKEAGLTVVPVCPFVKGFVEKNAFEGYRKPNHEDMELVKSQM

SEQ ID NO: 6102 - protein, 155 aa, Corynebacterium glutamicum
MPKSLTFEDSINIAAPINQVYALVSDITRTGEWSPVCEKCWWDEDEGPVVGAHFTGRNVTPERTWETRSEVIVAEPNRCFGWSVTDGNVKWIYSMEPLEEGTVLTESWEFTPKGQRFFHDKFGDKSIEEIEKRRLAAITGIPETLVAIQRILEVE

SEQ ID NO: 6103 - protein, 141 aa, Corynebacterium glutamicum
MSKREESIEYGPLGKGHDPLKDPMKGIRGVMAGTLVMEAITLGLVLTVILRVDDGIYWTTFNWVYVSAVAIAHFVAAFLQRFSWSIPMNIVLQVLALAGFFVHPAMGFAAIIFIIAWAYLFYLRSNLIDRMKRGLLTTQHS

SEQ ID NO: 6104 - protein, 458 aa, Corynebacterium glutamicum
MLRLAQVEAELDQRWLETKIDPTFRRMSYMMDLMGQPQNSFPAIHVAGTNGKTSTTRMIESLLRAFHRRTGRTTSPHLQLVTERIAIDGKPIHPRDFVRIYEEIKPYMEMTDAWSEAEGGPKMSKFEALVALAYAGFADAPVDVAVVEVGLGGRWDATNVINAAVSVITPVGMDHVDRLGNTIGEIAGEKAGIIKARPASEDGTEPEGNVVIVGKQEPEAMNVILQQAVDVDAAVARLNMEFGVVESAIAVGGQQLTLKGLGGEYTDIFLPLSGAHQADNAAVALAAVEAFFGASAGRPLDIDTVREGFAQVQSPGRLERLRSAPTVFIDAAHNPHGAAALGAALDRDFEFRRLIGVIGVLCDKDARGILESLEPYLHEIVCTQTASERALDAYDLAEYAREIYGDERVHVQEDLAGAVELAIELAEDTDVQSGSGVVITGSIVTAGDARTLFGKEPA

SEQ ID NO: 6105 - protein, 204 aa, Corynebacterium glutamicum
MRSTSSWAICARPRILSTTASGALDRKASLPSFFAVVSNSFCALARSFSRRLRSAATSTVPEVSSSTVMVAWLRRISRLAEAAKSSSGCSMRTRERTESSRSCRSHATKSRRAGTFWEGFTPWSARKRRTSVTSFSTSPMRLAASASTATPPLVSAAVGQEATTMEVRSVSACHRTSVTKGIAGCSRRSSASKTWPSTFWVFSP

SEQ ID NO: 6106 - protein, 238 aa, Corynebacterium glutamicum
MAKHLLGVFTLSGGAFAWDLNLRDFQVPVTELVPREVVELLVGLRELVVVQVSINVEANLLKEVHDPAVSVGEFFTCWQAFGHCTVHQRKLGCVEQLGGKVTGALCRVFTDRQVDAWVSATGKGEAQRIRAVVLHPIHRIDAVAQRLGHLAAVLIANQAVQEEVGEWNLWASILAFAQKFWGFLGCKGAEHHHAGNPEEQDVVGGDQHGGWVELLQLRGLFWPTHCRKWPQRRREPGI

SEQ ID NO: 6107 - protein, 221 aa, Corynebacterium glutamicum
MHVVNPVKVARLQGLRVDGGVAFAHGIAGHLGQLFDLDEPLQRQTRLNSFAGTLGVSDGVDVWANFLDNATLGCEFFADLDACFFAGQAIKLGSGIGNASGLVHDGRHVQVVAQAKSVVIRVVCWGDLDGTGAELWVDVIISNNLQAQVIAEWVRQGLSDQILVALIVWVHGNSDVAEHGFHTGGGNNDMWFIVVEGTIANGYQFAFDILVDNFDVRNRGF

SEQ ID NO: 6108 - protein, 900 aa, Corynebacterium glutamicum
MTDQNNETTSQNRADKLPKSWDPKAVEADLYQGWVDAGYFTADPASDKPGFSIVLPPPNVTGQLHMGHALDHTLMDALARRKRMQGFEVLWLPGMDHAGIATQTKVEEMLKETEGKTRYDYDREEFIAKVWEWKQEYGGKIGEQMRAIGDSVDWSRERFTLDDGLSRAVQTIFKKLFDAGLIYQANRLVNWSPVLETAVSDIEVIYKDVEGELVSIRYGSLNDDEPHVIVATTRVETMLGDVAVAVHPDDERYKDLVGQTLPHPFRDDLSLKVVADDYVDPEFGSGAVKITPAHDPNDYALGLRHNLDMPTIMDKTGRIADTGTQFDGLTREEARIKVREELAAQGRIVKEIRPYVHSVGHSERSGEAIEPRLSLQWFVKVEELAKMSGDAVREGDTTIHPKSLEPRYFDWVDNMHDWTISRQLWWGHRIPIWYGPNDEIICVGPDEQAPEGYVQDPDVLDTWFSSALWPFSTMGWPEKTPELEKFYPTSVLVTAYDILFFWVARMMMFGTFAAKETPELLGEGKDGRPQVPFTDLFLHGLVRDEHGRKMSKSLGNGIDPMDWVENYGADALRFTLARGANPGVDLPVGEDSAQSSRNFATKLFNATKFALMNGAVSEGLPAREELTDADRWIVDLLEQVRLDVDAYLDNYQFAKANEELYHFAWNEFCDWYLEIAKVQIPREGTSAQGENTQKVLGHVLDALLRLLHPAMPFVTEVLWQALTDRTSIVVASWPTAADTNGGVAVDADAARRIGDVEKLVTEVRRFRADQGVKPSQKVPARLDFVACDLQDLEDSVRSLVRIEQPEDDFAASASLEIRLSQATITVELDTSGTVDVAAERKRLEKDLANAQKELETTAKKLGNEAFLSKAPDAVVDKIRGRAQIAQEEVERINKRLEELA

SEQ ID NO: 6109 - protein, 525 aa, Corynebacterium glutamicum
MRTATKVIATVMASTLAIGLASCSSSSGTPDVNYVSVNGTEPQRGLIPGDTNENGGGRVVDMLYSGLVYFDEAGVAQNDLAASIDQETDTTYKITLRDGIKFSDGSDITATDFVDTWNFVVENGLLNTSFFSPIKGYEEGVETLEGLNVVDDRTFTIELAQPDSEFTQRIGYYGFAPMPASARDDIDAFGENPVSSGPYKLEQWDHNAELKVVANEHYDGPRAANNDGLKYVFYAQNDAAYSDLLAGNLDVLDLIPPSAYTTYEEELSGRSINQPAASYLELSIRMESPNFEGQQGQLRRQAISMAINREEIAEQIFAGTYTPALDFTAPVLDGWRDDLNGNDVLTFQPDKARELWEDAEEIAPFEGELQISYNADVPNREWVDAVANSISNELDVNATGNPFPDFKSFRDTYRTTGLDGAYRTAWFADYPSIGNFLGPNYTSGVASNDAKYENPEFDQLIADAAAASTKEETFQAYAQAQEMLLRDLPAIPLWYPNVVGGYSESVDNVSVNWKAIPVYWAITKQ

SEQ ID NO: 6110 - protein, 484 aa, Corynebacterium glutamicum
MRFGLDLGTTRTIAAAVDRGNYPIVTVEDSLGDTHDFIPSVVALKADRIVAGWDAIEVGQDHPSFVRSFKRLLSEPNVTEATPVYLGDHVHPLGAVLEAFAENVVTALRAFQTQLGDTSPIEVVIGVPANSHSAQRLLTMSAFSATGITVVGLVNEPSAAAFEYTHRHARTLNSKRQAIVVYDLGGGTFDSSLIRIDGTHHEVVSSIGISRLGGDDFDEILLQCALKAAGRQHDAFGKRAKNTLLDESRNAKEALVPQSRRLVLEIGDDDITVPVNKFYEAATPLVEKSLSIMEPLIGVDDLKDSDIAGIYLVGGGSSLPLVSRLLRERFGRRVHRSPFPSGSTAVGLAIAADPSSGFHLRDRVARGIGVFREHDSGRAVSFDPLIAPDTDSATVAKRCYKAVHNIGWFRFVEYSTVSEDGSPGDISLLSEIKIPFDSSITDVDATEISRFDGPEVEETITVNDNGVASISIKILGGVTVEHTI

SEQ ID NO: 6111 - protein, 195 aa, Corynebacterium glutamicum
MTSLFDAPTLQRVTVFTGSALGSSSLYTQAAQTLAKTAVDRGIDLVYGGGKVGLMGIVADAFLESGGEAFGVITESLMKGELGHEKLTELEIVPDMHIRKRRMAELGDGFIAMPGGAGTLEELFEVWTWQQLGIHQKPVALYDVDGFWQPLLEMLEQMTQRGFIKRDFFECLIVESDPHALLKAMQTWTPPAPKW

SEQ ID NO: 6112 - protein, 328 aa, Corynebacterium glutamicum
MNSPQNVSTKKVTVTGAAGQISYSLLWRIANGEVFGTDTPVELKLLEIPQALGGAEGVAMELLDSAFPLLRNITITADANEAFDGANAAFLVGAKPRGKGEERADLLANNGKIFGPQGKAINDNAADDIRVLVVGNPANTNALIASAAAPDVPASRFNAMMRLDHNRAISQLATKLGRGSAEFNNIVVWGNHSATQFPDITYATVGGEKVTDLVDHDWYVEEFIPRVANRGAEIIEVRGKSSAASAASSAIDHMRDWVQGTEAWSSAAIPSTGAYGIPEGIFVGLPTVSRNGEWEIVEGLEISDFQRARIDANAQELQAEREAVRDLL

SEQ ID NO: 6113 - protein, 259 aa, Corynebacterium glutamicum
MATSRRDAENIDQAGSEFIESDSGHTATPEEVVATALTFFAEDGFSETKLEKIAKASGMSKRMIHYHFGDKKGLYIKAVSYALRLLRPEAEAMQLDSAVPVDGVRKIVEALYTCITKHPEAVRLLLMENLHSQDSVDSTAAYSDESNVLLNLDKLLMLGQDAGAFRPGISAEDVLVLISSLAYFRVSNKVTLKNLYSLDLESEANIEGMKRIVVDTVLAFLTSNIQNSGNSSYLVVGGKTAEPETDDSVYSFDTDVFEN

SEQ ID NO: 6114 - protein, 192 aa, Corynebacterium glutamicum
MTLRSALLALLSSGPLTGYDASQRFGASVGFVWSGSDSQIYPELRKMEAEELLVGSDVPWGSKGATKTEYALSEKGWEALRKAWYEPVTYGPTRDPARLKAAYFEVGTNGDARRHLRAHIAHFEQQKIQSESMIDELKAKTHPTLARRLERSPKKEHERIVAFKVLAYEGQIARAQAEIEWAEKGLKLLDTL

SEQ ID NO: 6115 - protein, 376 aa, Corynebacterium glutamicum
MTLSERKLTTTAKILPHPLNAWYVAAWDYEVTSKKPMARTIANKPLALYRTKDGRAVALADACWHRLAPLSKGKLVGTDGIQCPYHGLEYNSAGRCMKMPAQETLNPSAAVNSYPVVEAHRFVWVWLGDPTLADPTQVPDMHQMSHPEWAGDGRTISADCNYQLVLDNLMDLTHEEFVHSSSIGQDELSESEFVVTHTEDSVTVTRWMHDIDAPPFWQKNMNDKFPGFEGKVDRWQIIHYYYPSTICIDVGVAKAGTGAQEGDRSQGVNGYVMNTITPDSDRSSHYFWAFMRNYRLESQTITTQLRDGVSGVFKEDEDMLTAQQDAIDANTDYEFYSLNIDAGGMWVRRILEEALSKEGRLDIPTTFPRATPKPEA

SEQ ID NO: 6116 - protein, 325 aa, Corynebacterium glutamicum
MNSQWQDAHVVSSEIIAADIRRIELSPKFAIPVKPGEHLKIMVPLKTGQEKRSYSIVDARHDGSTLALSVLKTRNSRGGSEFMHTLRAGDTVTVSRPSQDFPLRVGAPEYVLVAGGIGITAIRSMASLLKKLGANYRIHFAARSLDAMAYKDELVAEHGDKLHLHLDSEGTTIDVPALIETLNPHTELYMCGPIRLMDAIRRAWNTRGLDPTNLRFETFGNSGWFSPEVFHIQVPELGLHATVNKDESMLEALQKAGANMMFDCRKGECGLCQVRVLEVDGQVDHRDVFFSDRQKESDAKACACVSRVVSSPSSSPTSTITVALS

SEQ ID NO: 6117 - protein, 475 aa, Corynebacterium glutamicum
MRLRVSSSLLPFLVPNLDHYGRPLLKEPGMDIRQTINDTAMSRYQWFIVFIAVLLNALDGFDVLAMSFTANAVTEEFGLSGSQLGVLLSSALFGMTAGSLLFGPIGDRFGRKNALMIALLFNVVGLVLSATAQSAGQLGVWRLITGIGIGGILACITVVISEFSNNKNRGMAMSIYAAGYGIGASLGGFGAAQLIPTFGWRSVFAAGAIATGIATIATFFFLPESVDWLSTRRPAGARDKINYIARRLGKVGTFELPGEQSLSTKKAGLQSYAVLVNKENRGTSIKLWVAFGIVMFGFYFANTWTPKLLVETGMSEQQGIIGGLMLSMGGAFGSLLYGFLTTKFSSRNTLMTFMVLSGLTLILFISSTSVPSIAFASGVVVGMLINGCVAGLYTLSPQLYSAEVRTTGVGAAIGMGRVGAISAPLLVGGLLDSGWSPTQLYVGVAVIVIAGATALIGMRTQAVAVEKQPEALATK

SEQ ID NO: 6118 - protein, 310 aa, Corynebacterium glutamicum
MAGVITGFAIILSVIGVGFLLAKLGVINDDKQRLVLNRIAFYAATPALLFNVVARSDPSALISPVIVVTFVATIVTAAVYCVISAIFFKKDIATTATGAAASAYVNSNNIGLPVSIYVLGTGAYVAPILVMQMVIFAPMILAALTSGDVKGSRGQKIWAAVKGSLLSPIVLASIAGLIVCLLEIQLPAAVMEPTIILGGASIPLILMSFGASLPSTNVLASKADRPSVLTATAIKIVGMPAITWLIAKAFGLEGDYLYAAVILAALPAAQNVYNYAATYRKGEIVARDTVFLTTFLALLGMLGIAALFGR

SEQ ID NO: 6119 - protein, 426 aa, Corynebacterium glutamicum
MARMQESADLLKCSFCGKSQKQVKKLIAGGAVYICDECIELCNEIIEEELGQAQHDEQERNELPKPSEISAFLDTYVIGQDPAKRILSVAVYNHYKRLRASETIGRRRNDEPETELVKSNILMLGPTGSGKTFLAQTLAKLLDVPFAIADATSLTEAGYVGEDVENILLKLLQAADFDVERAQRGIIYIDEVDKISRKSENPSITRDVSGEGVQQALLKILEGTVAAIPPQGGRKHPNQDFIQLDTTNILFIVAGAFSGLEKVIADRNGKKGLGFGVEVSSKKEEANIVDIFKDVLPEDLVKFGLIPEFIGRLPVVATVSNLDQKSLVKVLTEPRNSLVKQYRRLFEMDDAVLTFTDDALEEIANQALERKTGARGLRAIMEEILVPIMYDLPDRKDVGEVIINGAVARGEAEPEMLEAVAEEKTA

SEQ ID NO: 6120 - protein, 362 aa, Corynebacterium glutamicum
MNPEFIHGATEIETTNRGLRPHRLSKEIVERYCDPQFSAMERQPSGVRVVCRTTATSVTLTTYSTRVVYLDSGRPGGKIDVLIDGAPTSSTPTSGGETTEVNFITGATERRLKDPQVLTVDGLSEQEKVVEFWLPHNEEIEVISLKANAALNTVEDTRPVWINYGSSISHGSVATAPTKIWPAIVAQSKNYNLRNFGFGGSAMLDPFMARLIRDTPADLITLEIGINIVNGDVMRRRGLEAAVDGFINTIRDGHPTTPIKIVSPFYCPIHEKTPGPGAFDTSSFGSGQIRFIATGEPDEHGRLTLEMVREVLEGFVEKQKDPHLTYVDGASLYQASDAPLLDNLHPDEASHALIAQRLLKQL

SEQ ID NO: 6121 - protein, 211 aa, Corynebacterium glutamicum
MTWDHNQMAARVAQELEDGQYVNLGIGMPTLIPGYLPEGLEVILHSENGVLGVGPYPTEEELDPELINAGKETITVAPGASYFSSSDSFAMIRSKSVDVAVLGVMEVSQYGDLANWMIPGKLVKGMGGAMDLVHGASKIIAMTDHITKKGAPKILKECRLPLTGAKCVDMIVTTHAVFSVDPEEGLTLIECADGVTVEELREITEADFKVA

SEQ ID NO: 6122 - protein, 250 aa, Corynebacterium glutamicum
MSHMINKSISSTAEAVADIPDGASIAVGGFGLVGIPTALILALREQGAGDLTIISNNLGTDGFGLGLLLLDKKISKSIGSYLGSNKEYARQYLEGELTVEFTPQGTLAERLRAGGAGIPAFYTTAGVGTQVAEGGLPQRYNTDGTVAVVSQPKETREFNGQLYVMEEGIRADYALVHAHKADRFGNLVFRKTAQNFNPDAAMSGKITIAQVEHFVDELHPDEIDLPGIYVNRVVHVGPQETGIENRTVSN

SEQ ID NO: 6123 - protein, 264 aa, Corynebacterium glutamicum
MRTKRGVDGMVEQSPDFVQSFARGLSVIRSFSADNPSQTLSEVASQTGLSRATARRFLHTLTDLGYAVNNDSRFQLTPRVLELGASYLSALSLPAIAQPRLEVLSRQVGESSSMSVLDGTDIIYVCRVPVRRIMTVNITIGTRFPAYATSMGRIMLANLPEEELDEMLAAAPPEQLTTRSLTSIASIREEIIATRERGWSLVDQELEPGLRSLAAPITNAQGEVVASINVSTQSASHSVEDIRKLVLPQLLETAQAISTDLSAL

SEQ ID NO: 6124 - protein, 408 aa, Corynebacterium glutamicum
MNPQDIVICSPLRTPVGAYGGSFTGVPVEELATTVINAIVEATGITGDDVDDLILGQASPNGAAPALGRVVALDSKLGQNVPGMQLDRRCGSGLQAIVTAAAHVASGAADLIIAGGAESMSRVEYTVSGDIRWGVKGGDMQLRDRLAEARETAGGRNHPIPGGMIETAENLRREYGISREEQDKISAASQQRWGKAADAGLFDDEIVPVTVPAKKRGQEPTIVSRDEHGRPGTTVEKLAALRPIMGRQDAEATVTAGNASGQNDGAAAVIVTTRAKAEEKGLRPVMRLAGWSVAAVPPETMGIGPVPATKKVLDRLGLTLEDIGAIELNEAFAAQALSVLKEWNISWEDERVNPLGSGISMGHPVGATGARMAVTLAHRMQRENTQYGLATMCIGGGQGLAAVFEKEN

SEQ ID NO: 6125 - protein, 304 aa, Corynebacterium glutamicum
MSSRVRPKRSRTFLVAGTGPIPMVSGGTAATDQPAKRMTGRRPFSSALARVVTMTAAAPSFWPDALPAVTVASASWRPMMGRKAASFSTVVPGRPCSSRETMVGSWPRFLAGTVTGTISSSKSPASAALPQRCWDAAEILSCSSREMPYSRRRFSAVSIMPPGIGWLRPPAVSRASARRSRSCMSPPLTPQRISPDTVYSTRLMDSAPPAMIRSAAPDATCAAAVTIACRPEPQRRSSCMPGTFWPSLESRATTRPSAGAAPLGDAWPRIRSSTSSPVMPVASTIALITVVANSSTGTPVKDPP

SEQ ID NO: 6126 - protein, 251 aa, Corynebacterium glutamicum
MAILHSVSYGTSDNTLVFIGSLGSTTDMWLPQLDALHKDFRVIAVDHRGHGLSELIEGTPTVADLAQDVLDTLDDLGVGNFGVIGLSLGGAVAQYLAATSDRVTKAAFMCTAAKFGEPQGWLDRAAACRENGTGSLSEAVIQRWFSPTWLENNPASREHFEAMVAGTPSEGYALCCEALATWDFTDRLGEITVPVLTIAGADDPSTPPATVQIIADGVGGESRAEVLSPAAHVPTVERPNEVNELLAQHFA

SEQ ID NO: 6127 - protein, 687 aa, Corynebacterium glutamicum
MFTTSLLPRRQLLLRRLLAEFTTDRRGRFLVVTGPHGVNKEHFTREFAAELGEFEVNPFLKKRPRASIVVVDDVHLADKDDIQKTLNLVHTKGLTVLATAPHRIPGATDLLALPPLTVPETALLARQIVGHCTPTTAHRLNDAAGGLPQLIRELLDATPIDHWSNDRPTLTLPEHWVTDIDIKNPVLREVASHPFFDGCPIGDLDADAFVEDGTLIHENGTLRFRSPEERTLVRASTPPSMARSPREWESTEGGVDKLIAAGNLPLARLHVEELPRADEQRAFLALYGGQSFEAASASPFYALATWNPEALRGDPTFDMFADALDTGHYREVPRPDAPEESQIHDFISGWLALVYDDPLTARRLLSRRGPSDLVGLWQSAFLARAHYVLGEFQEASAVVERGLATGDRTGASLLEPVHLWTGAQVAAMTGRTELANHYLQRLTVPDDAFLIQKLSASMGKLITASMTSDTRAATLAGDRMASVVYTTNTQQPGFWAWEDMYAISLIRTGRIDAAAAVMDGIPDSTIPSLRARNLVPQANIEIQRGSTARGVKMLSEAVDLISSVNMPAYEARILFEYGLVLRRMGRRSQAAEMFTHAEEVFTAMGAVTLAARCHGERRVAGVGPRRSAQGLTPQEEQITALVVDGCSNQEVARELSLSAKTVEYHLTRVYKKLGVSSRGELRELLKV

SEQ ID NO: 6128 - protein, 122 aa, Corynebacterium glutamicum
MDRYETGMKNRREVLGDAHVDRAVANTTEVTEKFQDFITRTAWGDIWERPGLDHTQRRLLTIAILTAVGNDGELDMHIRAALRAGVDQETIGEVILHTAVYAGVPNSNHGFKLLNNAVSDLQ

SEQ ID NO: 6129 - protein, 226 aa, Corynebacterium glutamicum
MVAFAIAACSGAAATAKAASTTRRFFRKVSSERLLRCSPLPARSEYKDRVNLESKKWGFIVFSLDSDVEAESIIGLLSHQEVTSISWDHSQNWVGAQIGVWQVCASVQTLQHATGEHTNLEVWCLICECSRNQSGERCLTLRVCHRATKPAEAICGCWCCAVWIQIRVVDALWIGLPQFKHGIRDGVAVAISCGNSKGHRAFRTWLHEMLRTFKGQTDVDVRAHGL

SEQ ID NO: 6130 - protein, 372 aa, Corynebacterium glutamicum
MKPHFLDSKLTRSLYSDLAGSGEHLSSLSDETFLKNLLVVEAALAVAAAPEHAAMAKATIDSYQLDVEELSRRAAEGGNPLIPLVTDLKAINPAGIHIGATSQDIIDSALMLCMKEGVGEVVDKLKKLARDLAELTAEHKATPIMGRTLGQIATPTTFGALTGGWLVAVDNAARALEALEFPVSYGGASGNMTAVHPRGFEIQAKLAEELGLFDPQWVWHSDRTPITAIASALATAAGVVRKIAGDVVFYSQTEVGELREKSPGGSSAMPHKANPAAAIACDGYARRAPGLLATLFDALDCRLQRGTGSWHAEWATLRELAAVTHSAVSRAATSIDGITVNVDVMASRVNGPTGHAEDLAERALEIYGKGRS

SEQ ID NO: 6131 - protein, 204 aa, Corynebacterium glutamicum
MIDTGKNGEFRYEQSNIIDQNEAEFGITPSQTVGPYVHIGLTLEGAEHLVEPGSEGAVSFTVSATDGNGDPIADAMFELWQADPEGIHNSDLDPNRTAPATADGFRGLGRAMANAQGEATFTTLVPGAFADEAPHFKVGVFARGMLERLYTRAYLPDADLSTDPVLAVVPADRRDLLVAQKTDDGFRFDITVQAEDNETPFFGL

SEQ ID NO: 6132 - protein, 230 aa, Corynebacterium glutamicum
MDIPHFAPTGGEYSPLHFPEYRTTIKRNPSNDLIMVPSRLGESTGPVFGDRDLGDIDNDMTKVNGGEAIGQRIFVHGRVLGFDGKPVPHTLVEAWQANAAGRYRHKNDSWPAPLDPHFNGVARTLTDKDGQYHFWTVMPGNYPWGNHHNAWRPAHIHFSLYGRQFTERLVTQMYFPNDPLFFQDPIYNAVPKGARERMIATFDYDETRENFALGYKFDIVLRGRNATPFE

SEQ ID NO: 6133 - protein, 388 aa, Corynebacterium glutamicum
MEMSYFSHQDPNNPESHINFTMAQMEIQRWTLLISNPEADASTLVMELKTVTGESKHFINQAINAMWALMKLPILRVVVETHFHVRIPYLARIMQAVKQAKPELWDELDHRIAEKLTPRIAGQALMEASALAGLITRWIKELDPTFTGKKRGPKGSDGTLTFRHVDGRTYISGNIDGVTGKLFQKALEKVKQKGEDLARALVTFLAGRTKVKIVSAVYTPLVGGVSWIPGVGFLSQEESRKLGKTASKVIDLDTIATRVENGYTPSPELRLYVMGRDGTCRHPGCTVSADNCQIDHVIPFGEGGLTVAWNLQCLCAHHHNMKTDGRIQAAIDSMGRVAWIGPCNRTVVTEPVGPLAQEMPTGQWGQTLEARMEKTFEKLRSSLEVLDD

SEQ ID NO: 6134 - protein, 97 aa, Corynebacterium glutamicum
MLFLARMDVVFPDSMDADVMADFQAKEKAYSGDLQSRGIMKAIWRVVGEYANYSIFDVDDHDELHAILSGFPMFKYMNVKITPLAKHPNALEYYLKG

SEQ ID NO: 6135 - protein, 257 aa, Corynebacterium glutamicum
MAGQPAGFGDSGDLLGFQQTTVLSGFQCDNIRSLGFHHRESFSWGPHGFICHDRNVGAAGDFAQGFQVVGRGGLLEQLDASLRENRQVMQSGAAIPTCVNINAQRNAVANFARQFCYTASIFRRIASTHLQLEGTVTKLLDALFNFRHRNIKRQNAQRPGDIHLVAHGATKQVADGHIEAACPGIMHCDVNSRLGITRTCNNTLKVCHNSCKLGDSTADEHWGEVAVDKRLHGLNRLAAPPWTAGHNALTVADDTVF

SEQ ID NO: 6136 - protein, 373 aa, Corynebacterium glutamicum
MSDLTIQKVESRILDVPLIRPHGFATTTSTEQHILLVSVHLENGVIGYGEGVVPGGPWWGGESVETMKALVDGYLAPVLIGRAVSELAGIMADLERVVARARYAKAAVDVAMHDAWARSLNVPVRDLLGGTVRDKVDVTWALGVLPLDVAVAEIEERIEEFGNRSFKLKMGAGDPAEDTRRVAELAREVGDRVSLRIDINARWDRRTALHYLPILAEAGVELFEQPTPADDLETLREITRRTNVSVMADESVWTPAEALAVVKAQAADVIALKTTKHGGLLESKKIAAIAEAGGLACHGATSLEGPIGTAASLQFAASTKAISYGTELFGPQLLKDTYIVQEFEYKDGQVAIPQGPGLGVDVDMDKVNFYTRK

SEQ ID NO: 6137 - protein, 202 aa, Corynebacterium glutamicum
MRDLVRRRLQGLDLVAAFLIGNDGATQVPLWDSRRELGVVSVLICVPELNFCSIKTVAVEVSNLPLEDQWGACAVLVTHWHFSIPRELRRVLYVIRAFDGTLGSGVVVAVVVDLFDLMLNENVQPQWPLAVFSNVDHPLLEHCVLFVGDFVLVSNLGDRREQIYVDRVCAFLGGIGGNAVCLELVSCLVARIVGCWINDLFS

SEQ ID NO: 6138 - protein, 285 aa, Corynebacterium glutamicum
MTSAEQIVDPTAHDSGNKATDKFKANRVSSDTSKERANAIYVDLLAAIAQVAHKHEVTYEEYAVLKQWMIDVGEYGEWPLWLDVFVEHEIEEINYNRHDYTGTKGSIEGPYYVENSPKLPWDAEMPMRDKDRACTPLIFEGQVTDLDGNGLDGAEVELWHADEDGYYSQFAPGIPEWNLRGTIVTDEEGRYKIKTLQPAPYQIPHDGPTGWFIESYGGHPWRPAHLHLRVSHPGYRTITTQLYFEGGEWVENDVATAVKPELVLHPETGEDGNHVHYPFVLDKED

SEQ ID NO: 6139 - protein, 47 aa, Corynebacterium glutamicum
MGLCGKIYTSKGSLIVFKVFGMLTDSMIQATVLLSSSADHKDFSARQ

SEQ ID NO: 6140 - protein, 490 aa, Corynebacterium glutamicum
MASVQKTLDHALEDRPEEGIVRVNRNIFTDPEIFELEMRHIFEGNWIYLAHESQIPNAGDYFTTYIGRQPIMITRSKDGTLNCLINACSHRGAMLCRRKTDNRTTLTCPFHGWTFSNDGALLKVKDEKEGAYPENFRTDGSHDLRRVPKFESYRGFLFGSLNDDVVSLEEHLGDTRTVIDMLVDQSPEGLEVLRGSSTYTYDGNWKLQTENGADGYHVSSTHWNYAATTSRRGTGESANETKAMDAGTWGKQGGGYFSYPYGHMLLWMWWGNPEDRPLFERRDEFKKEFGEEKGEFMVGASRNLCLYPNVYLMDQFSSQIRHIRPISVDQTEVTIYCIAPKGESAEARANRIRQYEDFFNATGMATPDDLEEFRSCQKTYQASAFPWNDMTRGLGHQVQGPNEVAKGLGMNEVLSSGARTEDEGLYPIQHGFWHELMQEAVNKQSIKEKELADDTASSLATVAAAKIREEAKAAAKSDAGEPRRRRRTRG

SEQ ID NO: 6141 - protein, 164 aa, Corynebacterium glutamicum
MSEITRSEIEAFLYYEARLLDDRKFEEWLECYREDAEFWMPAWDDNGELTEDPQSEISLIYYPNRGGLEDRVFRIRTERSSATSLPEPRTGHSTTNVEILERRDGEVDIRFNWITFYYRYNTTDTYFGTTFITLDVSGETPKIVKKKVVLKNDYIHHIVDIYHV

SEQ ID NO: 6142 - protein, 512 aa, Corynebacterium glutamicum
MTHQVALAFEDGITRFIDCEDDQTVADAAYQARINIPFDCRDGACGTCKAFCESGDFDEGDYIDDALSEDEAADGYCLPCQMTPKTDLILQIATTSVLAKTGASTFDGELKEINHFSDSTIGIEIELENRQDLAFLPGQYMNIQVPGSDQTRSYSFSCAQDSGNVQFLIKVTPGGLMTTYLTDHAKVGDKLTLTGPMGSFFLREPVRPILLLAGGTGLAPILAILEKLSRDELLDVPIRLVYGANFTHDLVELDRLDAFKDKFDFDYITVLSDKDTEHPRKGYVPAHLTGEYEPDEDTDVYLCGPPPMVEAVRQFLGTLEHPPLDFYYEKFTSAAAPAAGKPEITVETSEVAEDFNLVEVSTPGMSSGEVHSSATQLQARMALELGALELAINKLGERDIERFRNLADIANSFIDGDKFIDAVKFTEANADFHEFLFRRANNEALLAAYQNLQVVQEMNATLPGAEWIDPAIATEHLALVDAVSQNDLETARTIIREHAEHGIDTMVKALEK

SEQ ID NO: 6143 - protein, 276 aa, Corynebacterium glutamicum
MSAPVGQGIEGRPTHVTPERFFGQGVVVTGAAQGIGMAVAHRIAYEDGNLVLVDRSPLVHEVAEELRKAGAGTVDSFIADLETFEGATDALEFAGQKLKNLDVVINNVGGTIWAKPYQEYSEEEIRKEINRSLFPTLWMCRAALPILIGNGGGTIVNVSSIATGGINRVPYAAAKGGVNGIVSAMAREAAPHNVRVVATAPGGTLAPERAVKRGPGPEGELEEKWYQQIVDQTIDSSLMKRYGTLEEQVAPICFLASEEASYITGSVMPVGGGDQG

SEQ ID NO: 6144 - protein, 895 aa, Corynebacterium glutamicum
MVASVSFTPSSSQTFLPRASIIVQEVSTQIKRLESGEGKLFHISGQPGAGKTEFGMQLIDELQGWTVVRATSLSWLKNSPRNLLGHIAHKLGAHSANSIRGVIDRLDASTVVIVDDVHWADVESMQKLIEYSMRMVSGRFALIMIGLDEENLVFHDEVVSLPSIADSTYVLPPMSIEEIRQLALTDVRGRISTTTATDIQRITGGIYGRVKEVLHSESPDHWRMPNPNIPIPQSWHANLLRRITNEEVWHVLLAVAVLPSGGPIDLVKLLGNDPTGMLCDDAVRSGLLRVLPSDGQPQVDLVLPIDRAVLQSRTPLNILAQLHHKAAEYYGKWNQKDAQLEHEAFAAIDPNDPAVRALAQRGYALGRTGHWMESAHALSLAANRTAHQEESNKYLLESIDSLIAAADLPQARSRASTLDLGETGIQQDSMLGYLAIHEGRRLEARNLLHRASEELLAQHPIDPIHGPRMAQRKVLLNLVDWNPEELLVWADRAVAWTEEDAGEKVEAQAISLIGQSILDGCLPEDKPIPGETTLHAQRRHMAMGWLSMVHDDPVTARQKLERRTSINGSERISLWQDGWLARSLLLLGEWESAARTVEIGLARAEQFGIRFLEPLLLWSGATIATARGNSDLARNYMSRLSTDQDSFIVQSMPSAMCRMWVHRHRNEIPGAIVAGEQLEKIAAHKHVNAPGFWPWQDVHATHLIRIGETERAQELVNSTLEELRGSDIMSAHAKIAVPDAMLMIHHGDVKKGFKRFDDALDMLDPLTLPYYRARICFEYGQALRRQGQRRRADEQFARAASLFQDMGADAMVTLANRERRVGGLGQRSEQAGGLTPQEYEIARLVSSGHANREVAQELFLSPKTVEYHLTRVYKKLGIRNRMELAEALKKYSHDA

SEQ ID NO: 6145 - protein, 460 aa, Corynebacterium glutamicum
MTMCDYFTSSRRISVASQISGGWQSAKHRTTVYMVLVVVGISILFDGYDLVIYGAVLSTLLEDPTQIGALSPAVAGTLGSYAMIGVMIGALSAGAVGDRLGRRKVMLTAIVWFSVGMALTAFASSIALFGFLRFLTGLGVGMIVATGGAIIAEFAPANRRNLFNAIVYSGVPAGGVLASILALLFEDVIGWRGLFLIGGSPLLFLLPLAYFFLPESPRWLTSRGRAADAKALCARYGLPTEEFVVEKQQETKGTGFAGIFSSKYLMGTILIGAMSFIGLLSTYGLNTWLPKIMESNGATSHDSLYSLLFLNGGAVFGGLIASWFADRIGAKTVITSTFALAAICLGVLPNISSWPMMYTAIAFAGVGVLGTQVLTYGLTSNFFGTECRAAGVAWCAGFGRLGGIVGPAIGGLIIGAGFGPSSAFLIFAAAAAIGAVCTLLIPRSPAEVEVKVAQEPLARV

SEQ ID NO: 6146 - protein, 414 aa, Corynebacterium glutamicum
MASSVLLAVEKPELPRPTFAEIKRDLGPQEIGNGLVALIFSASGPIAVILAAAAAGNLSPDQTSSWIFGAFLGNGLLTLWLTYMYRSPQAYFWTIPGTVIVGDSLTHLSFAEVIGAYLVTGVVVFALGWTGLIGRIMAVLPPTIVMAMVAGIFLRFGLDLIDASVTDPLIALPMVIVFVALSMSPRLASIAPPVAVAAVVGTIVAIASGKLASGILDNGIISRPVFTAPEFSFAAIMELVVPLAITVVIVQNGQGVAVLKAAGHRPGVNLAAAASGLWSLPMALIGNITTCLTGPTNALIVAGAKSHRHYTAAMVTAIGAIIVGLFSPTFVGFMLAMPISFIAALAGIAMLTPLKNAFIAGFSGDYSTGALVCFLVTVSEISILGITAPFWGIVFGWLIGWLLDSKLLENKKRA

SEQ ID NO: 6147 - protein, 208 aa, Corynebacterium glutamicum
MSNGFQMPTSRYVLPSFIEQSAYGTKETNPYAKLFEERIIFLGTQVDDTSANDIMAQLLVLEGMDPDRDITLYINSPGGSFTALMAIYDTMQYVRPDVQTVCLGQAASAAAVLLAAGAPGKRAVLPNSRVLIHQPATQGTQGQVSDLEIQAAEIERMRRLMETTLAEHTGKTAEQIRIDTDRDKILTAEEALEYGIVDQVFDYRKLKR

SEQ ID NO: 6148 - protein, 201 aa, Corynebacterium glutamicum
MTVFMSDIRMAAQGGPGFGNDVFDRLLSERIIFLGSQVDDEIANKLCAQILLLSAEDPTRDISLYINSPGGSVTAGMAIYDTMKYSPCDIATYGMGLAASMGQFLLSGGTKGKRFALPHARIMMHQPSAGVGGTAADIAIQAEQFAATKREMAQLIAEHTGQTFEQISKDSDRDRWFTAQEAKDYGLVDHVITLAEGPISN

SEQ ID NO: 6149 - protein, 50 aa, Corynebacterium glutamicum
MGTFIWFNVTRLPAYFHETASVRYQRFHRLKKQKNNASRRPVARRKALFL

SEQ ID NO: 6150 - protein, 449 aa, Corynebacterium glutamicum
MKSSVEKLSDTRSKITVEVPFSELKPEIDQAYAALAQQVQIPGFRKGKAPRQLIDARFGRGAVLEQVVNDMLPNRYAQAIEAEGIKAIGQPNVEVTKIEDNELVEFVAEVDVRPEFELPKFEDITVEVPAIKADEEAIEAELETLRARFSTLKDHNHKLKKGEFVTINITASIDGEKIEEATTEGLSYEIGSDDLIDGLDKALIGAKKDETVEFTSELANGEHKGKEAQISVEITATKQRELPELDDEFAQLASEFDTIEELRESTVSDVEAKQKNEQAAAIRDEVLAAALGEADFALPQSIVDEQAHSQLHQLLGELAHDDAALNSLLEAQGTTREEFDKKNVEDAEKAVRTQLFLDTLSEVEEPEVSQQELTDHILFTAQSYGMDPNQFIGQLQQSGQIANLFSDVRRGKALAQAICRVNVKDSEGNEIDPKEYFGEEEVAETESEA

SEQ ID NO: 6151 - protein, 165 aa, Corynebacterium glutamicum
MDKFFPTDQNDRDALFQRLEAIEAVIARHEALFAKEGHSINDSPETTDGAIHFSGQFENASGSISYSWSRPPHHLLEEAWDSSFTRLAALAHPQRGLILKQLLNDPCSVSTLCQLGVTSSTGTAYHHLNELESAGWVRKGRGGVYEVPTERIIPLLTIISASENH

SEQ ID NO: 6152 - protein, 325 aa, Corynebacterium glutamicum
MSIAVATTKQQKGFVTGQPTGALNLSDILDSEELGEYHLMSAAIITGNTVDFSGLGAGPDDPFEIASITKIFTGELLRLQIERGEITESTAVGDVLGERVADSLIRDITVEELANHTSGLPRLGNVGLRPFMATFFDKNPYKDLSADRVISISTTSKLNSRGEFHYSNLGFALLGQVLARNAGLTFDQLLDRDLLAPLNLNNTKLMTPESLAQDAPQGFSTPGKQVEAWEMDGFLPAAGLRSTARDMAVFCQYLFTKGPAPFTWQSLESAPEIVWHNGESFGYSSVLFFNTATTTAIFVAADVATSVFPIGHELLMANSTRQESK

SEQ ID NO: 6153 - protein, 152 aa, Corynebacterium glutamicum
MIDSPASIHRRIVATLADYSIALLIGGGIALAFGTSILNPLFSTVLTIAFWLSKSLLEAAFGTTPGKMLTHLHVNHDIHGERLSIYYSSARNAWILLEIIPLVGLVLFSFVAIFLVASCIRACNFMGLHDKFAHVNVLRKNEKHPLNCFKCN

SEQ ID NO: 6154 - protein, 83 aa, Corynebacterium glutamicum
MKPKIIDAESGRELWTAIECAEFSGTARGTFTSYAGRGRAPKPVAKLHGLTLWDSQTIEEWVDDRAAGNKGLINSEETVAVAN

SEQ ID NO: 6155 - protein, 146 aa, Corynebacterium glutamicum
MAGHTHKTHRTAYKQLEALARNGHLFTYIDPPAEVDGVVKSTTNCLEGGINAQIKALARNHRGMFDEHQRIAVDWWLLMHTQLPGDPVEIARQQNWGQDGLAKVPDLIQQEQPHDHDGRPATYDTGIDATPNNSSGIRQGWAGRFN

SEQ ID NO: 6156 - protein, 50 aa, Corynebacterium glutamicum
MLFGELSTGLRVTCFWTLRLTWTRQRWIFVVGQVVVMALSAPFLSVGGHD

SEQ ID NO: 6157 - protein, 42 aa, Corynebacterium glutamicum
MLSSPKSTPGSLLETAESHHTGTSRRLAQTPPRVLPHLRGLA

SEQ ID NO: 6158 - protein, 88 aa, Corynebacterium glutamicum
MAYTFDHVVAWRWCTKEDAYNYTHLFDQLQPPLIVTTDGQKRRTQSHHHDLADNENPTLPRPRQTQRPKTRHPKTRAELAEKHSGVSP

SEQ ID NO: 6159 - protein, 130 aa, Corynebacterium glutamicum
MFCQPQTHQNQATSPPQHQPVIHAGTTPNKVKRTRPNCPVCTGPMRKNSHYNKRHHPMALHHLQRHHHQHPTQRPPRPPIPTLYQLDPQLPSRTNLANQLGVTRRTLTNWFHDYWFVQVPRNTDRFRVYD

SEQ ID NO: 6160 - protein, 295 aa, Corynebacterium glutamicum
MVEILPSKLSSELKHSVEVLLLIAIVVGGGVFVASKMGSNNNKKQEEAKFADAQADARRWIERLGSQVLTIAGTDAASTQAIADASERYTAASSQISSATTPRQAELARESALEGLHYMNAAREIMGMTAGPELPPLEGQRNAGRVTEKRTIEQEGRQITASPVATDETPNYYPGGNVAGRPVPAGWYSEPWWASALRSGLWTAGSVMMFSAMFNGMAGVGYSAAAFENGYGEGYQDGLDAAGGDMGDAGDMGDAGADMGDVGGDAGGDGGGFFDGLFGGGDGGDGGGFDFDFDF

SEQ ID NO: 6161 - protein, 157 aa, Corynebacterium glutamicum
MRVYLGADHAGFETKNAIAEHLKAHGHEVIDCGAHTYDAEDDYPAFCIEAASRTVNDPGSLGIVLGGSGNGEQIAANKVKGARCALAWSVETARLAREHNNANLIGIGGRMHSEEEALAIVDAFLEQEWSNAERHQRRIDILADYERTGIAPVVPNE

SEQ ID NO: 6162 - protein, 232 aa, Corynebacterium glutamicum
MIPLGIIHQILQPGEALLPYAIVGLVILLPSSWLPRWAVAVLGEVSLVPAVVFGGGFLLIPSMFLIGSALVRYGVVDRAENAPRAMGVFFAVSAAIAIPTLIIQARDITSSGFSIVSTVAGLALGGVYISLVLLALHTPIRGALAAVFAPLGRMALTNYIGATILMLIGGLIVDLPHSTSWTATVLLAAGILIIQELLSALWLRHYTQGPLGYLWRWVTWGSRSPFLTRSAS

SEQ ID NO: 6163 - protein, 203 aa, Corynebacterium glutamicum
MAQKVTFWFDTTCPFCWVTSRWIKEVEQVRDIEIQWVPMSLAVLNEGRDLPEDYKERMKAAWGPARVFAAVATDHADKLGDLYTAMGTRIHNDGRGPIEGSFNDVIAEALEEVGLDAALGEVADTTEWDDALRAFHQTAMDEVGNDVGTPVVKLGDTAFFGPVLTRIPRGEEAGEIFDASFKLASYPHFFEIKRSRTENPQFD

SEQ ID NO: 6164 - protein, 867 aa, Corynebacterium glutamicum
MTSTNLTRQEASDRSRLLSVENYDIALDLNNGDEFFSSSTVVSFTVRKAGDTFIDLRAASVEEVRLDNVSIKDEALTLGKNGYDETFGIALKGLTPGAHTLRVTASIPYSRTGEGLHRMVDPADNEVYLYTQFETADAKRMFACFDQPDLKATYDLNIKTPKGWKIISNSEQQVSTQHTDYDTHISRVDYPLSTYLIAVCAGRYHEVCDVWKGTLTHHAETPADQPTELTVPLALYCRSSLAKDLDAVRLFTETKQGFDWYHRNFGVAYPFGKYDQIFVPEFNAGAMENAGAVTIRDEYVFASKATRYRYERRAETILHELAHMWFGDLVTMQWWDDLWLNESFATWSAAISQAEETEYNTAWVTFANVEKSWAYQQDQLPSTHPVFSDGYDIETVDQNFDGITYAKGASVLKQLQAYVGREEFLAGVRRHFANHAWGNASFDDLLGALEQSSGRDLSDWANQWLKTTGINTLGAKFTTDNGKYTSFSVTQTGAAPGAGELRTHRIAVGLYKLVDGSLNRYARVELDCSGASTSVEEIVGLEQADFVLVNDDDLTYALLDLDDDSRNFVIDNIDKFSDPMPRTLVWSAAWEMTRAGQMKARDFIALVARGAAAETEIAVLERILAQATSALKSYADPAWAEATGNDLLADAFLEGARSAEPDSDTQLAFIQALAKATLNDAAADYFRDILAGNVEGLTVDPDLRWWALTALIARGDIEAVEDAIAAELSRDNSSASFLASLRAGAAVNTEEVKAAAYKHVTAVDSGLSNLELRHKIEGLTFTGSSELLQAYNEQYFEILDDVWANFSGEMAQQIVLGLFPSWNVSEEGLKRTDEFLDGEHVAGIKRIVSESLDRTARALRNRAADAA

SEQ ID NO: 6165 - protein, 361 aa, Corynebacterium glutamicum
MSIEQAITSLSARVRELKPIIETEEATKTALIIPFISNVLGYDVTDPREVIPEYTADVGVKKGEKVDFAIKTGDDFHFLIECKKVGSPLSLDHANQLVRYFNVTDTEFAILTNGEIYQFYGQLDAANRMDAKPFMTLDLNNIDARQFPHLEMCTRKHFNPQALAANAEELKYIAELKKVIANQFQEPDVEIVKMLAATVTTKRMTAQNLEFFTRLVNTASSQFLKDEVNRRLRSAQVFEDPVQTQGADAETPAEDEAVIEEVVSEIVTTEEEIHGHSIVRAICCSEVSAQEITMRDAKSYCAILFQDNNRKPIARFYFDRKIPRIGIFNAEGEQEHFDLESIEDIYNHADLLHSRVVALNA

SEQ ID NO: 6166 - protein, 384 aa, Corynebacterium glutamicum
MSLAGVLYPRKGAVSLHSFPQRTQVNFWCYPRVIVKNSLIKNDQPIGMLRLLVKKVTVSMTENLDNALLSMRMKPVQMALMTLGYNHDMAVTDSGMELIVRRPGLTVNFNLDSVTLCIVADFMWHGCVPAKKQAEYLRAANEFNRPTRDLQVVLDEADSKNMTVRGREFFFSSVGATWEQSAEFVHYCMNDVATTFVSWCEQIWPKFSPERVEFNATPPDVDFEFSEDQLKEGNPFGLIDEPTPLVSLDRIYQQYELMGADQLKMGEDFVEYLHMGQRVSAWLTDGNNGSDRKTLAVSSGTGVKIKNKKQLQELLGLCNLYSKEHVLVTVFAEEIENGARWGIFAEARIDLPAGLNDHQLWVFLANSSKWTAEVCLTVAHRLQN

SEQ ID NO: 6167 - protein, 222 aa, Corynebacterium glutamicum
MSTIPDVFTSEVFPEISGTKEFRGLTYMFFDQFTLPTAEQLEQAKAAGWSLITWGWWNSDTDLEDVELEDITNEGDSLPKLTDEFAVSSLSTFDLNSQGLPNDDREPQPIEEADSLDDIFSEEEGWGLMAINCPNWQVPAACEWLGCMNVGEPFEMSHVLRVWQNSWGVEALAFGGEEDDADLLLRVPEESEELLKALAVASDQVTTYKHEDLGFLASLWFD

SEQ ID NO: 6168 - protein, 52 aa, Corynebacterium glutamicum
MTSGDPKLITLRSRNNKVVEITDARDRAFIKQADELIVKIDKLLESKRKKSR

SEQ ID NO: 6169 - protein, 109 aa, Corynebacterium glutamicum
MVGRIAIAAVAQIGRWAGIDGLESRIVVQRTIGPADFADRYNSWSGGSIGPSHTLAQSAFFRGSNKSRKVDGLYDAGDTTVPGVGVSMCLISAENVLKRLRGDNSVDRT

SEQ ID NO: 6170 - protein, 57 aa, Corynebacterium glutamicum
MREAGDELEEQTTRPQYCAGFGRREGGAHPAFSSDWDEDFRKVFDGSTPEFPASESI

SEQ ID NO: 6171 - protein, 126 aa, Corynebacterium glutamicum
MKSTSSNKTSTSAAAPGPSNSTASAGTPAPAGTSCPTPCPTSLSSAAPPSTTTSTSCHLNPPTASSTTTANSSTSPPTSMRWPSFSNPANPAPAPNCAPISTPPHRSTTWPSTASSTPTSPTSSHT

SEQ ID NO: 6172 - protein, 402 aa, Corynebacterium glutamicum
MERSVSKMTKAVVIGGGLAGLATTALLLREGYEVHLVEQNEHLGGRAGTFELDGFRWDTGPSWYLMPDAMSHFFKLCGTSIDDHLDLVPLEPAYRVIDDHGEFIDVTSDIDAMAELFESREPGAGAKLRTYIDSATQVYNLAIDGFLYTNFTNFIPYLSPGMLRLLPKLLASLSTSLKVKVNTQFRDTKLRQILSYPAVFLSSDPSHTPALYHLMSHTDLVQGVSYPRGGFTAFIKALISLIDDAVLHLGTPVSAITTQGRNATGVQVGSEFIEADIVISCADQHHTETQLLPASLCAKPETSWKNKQPGLSTVLVLAGVKGEHTLLFPPTGTKISAKFSTAPPQNSRLQNPSRSPRPPQQIPMPHPKATRTSSSWSQYPPMSPLVTGPLTEKNLTWWAGSQ

SEQ ID NO: 6173 - protein, 292 aa, Corynebacterium glutamicum
MKEASVADQQDFLGRFDAMSSKATATVIAHYSSSFTLASKLLSPKIRRDIEALYAMVRVADEVVDGAAAAAGCAPDAVAEILDNYERQVLLSLSVPFHTDPVIHAFGNTARKCGFEQAHIVAFFDSMRRDLSQTSYDPTQLDEYIYGSAEVIGLMCLKIFLQDSTASPQDRATMEHGARRLGAAFQKVNFLRDLAEDREGLGRSYLPVFTEEMRDEIVTDIREDLDAARLSIPLLPFGARTGVRAATDLYGCLVDNLESASLEDLKNGRIRVPSMKKASLATKAMWKEVFQK

SEQ ID NO: 6174 - protein, 373 aa, Corynebacterium glutamicum
MKKLQMAAILVGGFVGPFTGQALSVVLPEFADTFDISVSQAALTMTAYLLPFATMMLFSGRITRKIHPHKVVQAAYIVTLPLALLLLVTPSWGLFMAAYATIGIANAFTTPVLQIMLRELVPPRSLGKALGTYAAMQSLGMLSAPLIAGVSSVVSWRLTFLVTAAASLFILVARLPVVPPPSASKQNVSGKVQWGPTIIHMVSGFVVGIGIIGIGFMTSLHVGEQFGLDAAARGLVVMCGGLAAFFASRKIGDLADKFGVRAVLIVSAVIGTIALALLPIAPWIIVVAVLWAFAVAAAQGIQATVNLAVIGSPGGSSLLSTVQAFRFFGSAAAPVTFLPIYMGIGSGAFWVSAVALFFVAIAQWLNPQRVERG

SEQ ID NO: 6175 - protein, 411 aa, Corynebacterium glutamicum
MSDLIDMLVGEDLPQLRDNRPQARDNAQKSFEALLEPVNPGTFSFGERYAVATYVAGLHQFAPAVDLYQDLLLDDAPTTLANAVSDAIDEGLSAGPYGTYREPGLESESEPGGSVRNDAAKLGERLAAAFDYAHLLVFHPRDSRPEVLGRLSGAGWSADDTVTLAQLVSFLAFQLRVAYGLRTLKGEDIQVKAPRLSIPEAKWELSNNGFEISTYEELNRPEAFVNHSLGWKPWVPPVAKADLTEEQLDSLIQPERADMPYFRLLARDPAALKARTLTDLDIFFNTDGEGLGRAERELGATVTSRYNGCVYCASVHAGRAQEESGRADDVNALLASIDSDLGSDQWNVIRDAARALSSTPAAFNQGCITKLRGVGFSDLQIVDLINSVAFFNWANRLMLSLGEPEVPKRFL

SEQ ID NO: 6176 - protein, 547 aa, Corynebacterium glutamicum
MTTPLLEINDLVVSYQTAKGLVHAVNNVSLEVHPGQITAIVGESGSGKSTTAQAVIGLLADNAEVDSGRISFNGRSLVGLNAREWKNVRGTKIGLIPQDPNNSLNPVKTIGASVGEGLAIHKRGTAAERKKKVIELLERVGIDNPEVRYDQYPHELSGGMKQRALIAAAIALEPELIIADEPTSALDVTVQKIILDLLEDMQRELGMGILFITHDLAVAGDRADRIVVMQKGEVRESGYAASVLTDPQHEYSKKLLADAPSLTIGEIPTRVPAVDPEVAQAKGPLLVVDKFRKEHQRGKEGAFVAANDISFEVLPGTTHAIVGESGSGKTTLGRAIAMFNTPTSGSISVSGKDITNLSKAQQRELRQQIQLVYQNPYSSLDPRQTIGSTIAEPLRNFTKVSKQEADEKVAHYLELVALDPALATRRPRELSGGQRQRVAIARAMILEPELVVFDEAVSALDVTVQAQILRLLDDLQRELGLTYVFISHDLAVVREISDTVSVMSRGNQVELGKTAEVFNNPQTDFTRRLIDAIPGSRYRGGELNLGL

SEQ ID NO: 6177 - protein, 294 aa, Corynebacterium glutamicum
MSNPPISPKKPVSANPRTGSADPARKRKALGNPWTRPAAVISIVVLAVAVLMALVPGLFTSQDPFTGDDVALLGPSGTHWFGTDSVGRDLYSRVVYGARETLLGALIAVLVGLIVGTLIGLLAGAQRGWVDTVLMRFVDVLLSIPALLLSLTVIILLGFGTMNAAIAVGITSVATFARLARSQVMTVAGSDFVEAAYGSGGTQAQVLFRHILPNSLTPVFALAALQFGSAILQLSVLGFLGYGAPAPTPEWGLLISDARDYMATSWWLTVLPGFVIIAVVMSANYLSRIIQKEA

SEQ ID NO: 6178 - protein, 313 aa, Corynebacterium glutamicum
MTTSQILRRIGQAVLVLLVTFTLAFIMLSALPGDAVSARYSSPDLGLSPEQIAQIRESYGADESLIAQYFSTLGGFLVGNFGYSVQTGTAVATQLAEALPGTLTLAILAFLLAAILALVISILATMDRFAWIKGIFQALPPFFVSLPSFWLGIILIQIVSFRLGWVPVIGTTPAQGLILPTITLSIPITAPLAQVLIRSIEEVKAQPFIAAVRARGAGEMWIFFRNIIRNALLPTLTIAGILFGELVGGAVVTEAVFGRAGLGQMTVNAVANRDMPVMLAIVVIAAAVYVLINLIVDLLYPVLDARLRRRERA

SEQ ID NO: 6179 - protein, 569 aa, Corynebacterium glutamicum
MFKKHRHGLGSPETKPRSITRRFFTAAAATLAGLAVLSGCTAQPSQAEDNTLTYLEPQFFRTLYPPSAGFYPNGSVVNNIADRLLYQDPETLELKPWIATELPEVNEDATEFTFNIRTDVTYSDGTPLTAENVVKNFDLYGLGDQDRRLTISEQITNYDHGEVVDEDTVRFHFSEPAPGFAQATSSFNAGLYADSTLEFANEDFAPGNAQNVIGSGPFVITDETLGTNLTLTAREDYDWAPPSREHQGRAKLDAVNYVLAGEESVRIGAIVAGQGDIARQIEAPVEAHLKDAGIPIISAATNGVNNSFNFRFKNELLSDIRVRQALIHAIDREKIMRVLFSDSYPLATSVLAQNALGYKEQVDAYVYDLDKATALLDEAGWTLDSDGMRRKDGELLELTFNEALPQPRSREVVTMVQEQLGDLGIKVNLNPGDQAAQDADSKDLNKIQVRHTMVGRADYDVLKSQLYSTNRNELLNMTVEGETADIGDPHLEELLMAIASSPREEDRAAASAAAQDYITEQAYVLPLFEEPVVYGVQPYVKGFSPEVIGRPSFYETYIDHSSDHSSEED

SEQ ID NO: 6180 - protein, 647 aa, Corynebacterium glutamicum
MSTTDKQVAIVGVGPRGISILERIAAALNTVSRPKQGLTIHLIEDAQMGAGNVWRTDQTRTLCMNTLAGAVTLFTEPGSTVSAPVVEGPLQFDWIRLLRGDEDLSGIPTKAIELFRTYPPAASVAEDFKEELAATVIQSNPSRALYGAYLRWAFDVALQLLPQWVKVEQHHARAIGIREDGDRDVITLDNSEMISADSTVLAVGWQTPAPNAEELSIAAALEENPDLVWVKPGNPVEQDASLIPAGEQVLVRGLGMGFFDIMALTTIDRGGIFHEDPSTRSGLRYEASGEEPHFVISSGRGYPYLPKSDYKSLPPGAKLARLKAVIAAINAQNRGVASINYDAEVWPAVARDAYEAYYETLDRVSPESIRTGLDKIVEIIDEVDVDKLPKALAAHTDDVFDLHAWEFPLAGINESVEALTARIADGMARDIRHAVTAWDSPLKSALWSISAARKPSSILGAEGRLTFESRRNRFAAVMAIGQMVGSGPPLFRTRELLALVDAGLAHFAGARPRLSVSDGQWQISSPTTGDTPLRSKVLVDAWMHNPDVRRNADPLALSLEDADRVRPFNDYSVDGTAAPTGSPEVDPATRLLVHPNGNLDPRVHLIGIPTYGQLADTTISPMPGTNPLMLQETDKTAVHVLKQLGLI

SEQ ID NO: 6181 - protein, 438 aa, Corynebacterium glutamicum
MQAKEEEKRAFDNDRAHVFHSWSAQDKISPKVWAAAEGSTLYDFDGNAFIDMGSQLVSANLGHNNPRLVEAIQRQAARLTNINPAFGNDVRSDVAAKIVSMARGEFSHVFFTNGGADAIEHSIRMARLHTGRNKILSAYRSYHGATGSAMMLTGEHRRLGNPTTDPDIYHFWAPFLHHSSFFATTQEEECERALKHLEDVIAFEGAGMIAAIVLEPVVGSSGIILPPAGYLNGVRELCNKHGILFIADEVMVGFGRTGKLFAYEHAGDDFQPDMITFAKGVNAGYAPLGGIVMTQSIRDTFGSEAYSGGLTYSGHPLAVAPAKAALEIYAEGEIIPRVARLGAELIEPRLRELAEENVAIADVRGIGFFWAVEFNADATAMAAGAAEFKERGVWPMISGNRFHIAPPLTTTDDELVALLDAVEAAAQAVELTFAGALF

SEQ ID NO: 6182 - protein, 528 aa, Corynebacterium glutamicum
MVTTRGKGEDTMSITTHVQALTTALNAIDNHLASMLDHGVTPDQYKAIEPDLIALEHTINHHATIAAQTTALAERTNAAHTIGSTHLIDYLTTTFGLSKARAHHRINLAHSLYPIPKPNPGSGNGGNGGNPDGGPDGGDSGDDDSGDDDPDPEPDKPEDGKPDGDKPRGPRISAEKHAIITDELARLNPNTTPSAEELRTQALSQAIWRTPEDLRTWLRHHVTTANKNNPNPITAMKRRYLAVGKPDADNMVRISGLVPAATAALITANTAPLTKRGNLVDLPAAEDMRTRGQRHADALHHIMEIYNHGIVTPARGGTASIIISMTTDDLDEINHGDHGDGSLLNNLYPTNTGYSLNLAEIMNLIAAKYDFAVLLDGETGQPLNVNRMQRSANLTQRIALFASELVCSAPNCDRPQLECEVHHLDPWMRGGLTNLVNLTHQCFNHHPRNDDSRSGVNGKGFMDRDPVTGRVGHYSASGEGPVFNRSAAADRSGGAWARRKHHGPPPEPPSPPDPPGPEPDPGDEGRLF

SEQ ID NO: 6183 - protein, 249 aa, Corynebacterium glutamicum
MVFTLADSVSQVALGPSWLDPMELLSGSGPFGSFILPAMLAIVFIESGLLFPLLPGDSLLFTGGLLANQADPFAPLWLVLILCPIAAILGDQVGYWIGHKFHPRLVNRPDGRIFKQEYLKQTEDFFEKHGPVTIILCRFVPIVRTYAPLVAGMAGMRYRTFIIYNMIGGILWGSGVVALGAALGQFDFVRNNIDLIFLLIVFISVVPGLVGMARKLADGHKQANTEPQENPAVQTAPVKTQEAQEAPQN

SEQ ID NO: 6184 - protein, 236 aa, Corynebacterium glutamicum
MKKKIAVVTGATGGMGIEIVKDLSRDHIVYALGRNPEHLAALAEIEGVEPIESDIVKEVLEEGGVDKLKNLDHVDTLVHAAAVARDTTIEAGSVAEWHAHLDLNVIVPAELSRQLLPALRAASGCVIYINSGAGNGPHPGNTIYAASKHALRGLADAFRKEEANNGIRVSTVSPGPTNTPMLQGLMDSQGTNFRPEIYIEPKEIANAIRFVIDAGETTQITNVDVRPRIELADRKD

SEQ ID NO: 6185 - protein, 246 aa, Corynebacterium glutamicum
MPSETMKPAVASTLAATSTGRRPGRPTQRILSVESIVERTLNIAGREGFAAVTMNRLARDMGVTPRALYNHVLNRQEIIDRVWVRIIDDIKVPDLDPDNWRQSIHTLWSSLRDQFRETPRVLLVALDEQISTQGTSPLRIAGAEESLKFLTDIGLSLKEATIIREMMMADVFSFTLTSDYTFDNRPEGEKPDVFAPVPKPWLDENPDVEAPLTRKAVEESVSTSDELFGYMVEARIAYIEKLLAAK

SEQ ID NO: 6186 - protein, 147 aa, Corynebacterium glutamicum
MRTARVLRPRAVRYASKTDGIGPMPPCMNSSSSSISWSLVTTRPPTTSECPPMYLVVECRTACAPSFSGCCRYGDAKVLSTTSLALVPSVSFATASMSVMPSAGLVGVSTQISLVLSLIAALTSSTTEVSTTVYSTPHAVNTVSIRR

SEQ ID NO: 6187 - protein, 264 aa, Corynebacterium glutamicum
MLPMRELALNMAGVTVRRGEKLLLDDISLSIPQGSHWAVLGPNGAGKTTMLKIAATLLYPSEGTVDILGHRFGRVDTRELRKTIGLVDPKQRFTNLPAHEIVLSGLTASNGLLPRWSASASELERCALMLELVGMTARADRYWADMSQGEKARTLIARALIISPTLLLLDEPTTGLDLPGRETLLSVIDGLRAALPGLTTVMITHHVEEIAASTTDILMIKDARILASGTVSEVMTPENLGALYDMSVSLETVRSRWFAFDALH

SEQ ID NO: 6188 - protein, 131 aa, Corynebacterium glutamicum
MTTSENFYDSVGGEETFSLIVHRFYEQVPNDDILGPMYPPDDFEGAEQRLKMFLSQYWGGPKDYQEQRGHPRLRMRHVNYPIGVTAAERWLQLMSNALDGVDLTAEQREAIWEHMVRAADMLINSNPDPHA

SEQ ID NO: 6189 - protein, 376 aa, Corynebacterium glutamicum
MNRIAEIARSFGVLGFSAFGGPTAHLGYFRTEFVERRRWLDDRQYSEIVALSQLLPGPGSSQVGMMLGYHRAGFSGMAIAWLMFTWPSLALMAAFALLFDATSASWTLGLLAAAVAVVFHAVTGMARSMASTPRAATIAVASGIAVLALPNAFTHLGVIILAGLIGAFSFNSLIDATPPPSPLRAIPAWAGIGSLVVFLGALLGAVIMGGFYPAFIQAGSTVFGGGHVVLPLLEKLVVAPGFIKETDFLSGYSAAQAVPGPMFSFASYLGAIYGGIGGAVLASLAIFFPAALLSISGMYFWGRWRKAPRIQAAVTGINAGVVGLLGAALYDPVFTHGITSVSALAIATVCWLGLAHWKIPPWAIAAGAALAGWVLL

SEQ ID NO: 6190 - protein, 209 aa, Corynebacterium glutamicum
MVETLSITSGAAGLQALVARAVGLDELASARFRQLTPEVVDVFVTTPFNVTASRRVFGVAGRDGAAVGAKDLLQALSEGREDVGTSRDASWPGSLPPATGFTLVDELPTHVVRTLADQGQALARQFSGPLGPPASLMDQEVISAEGNGKKAGIPMRTVFTCTSLGLIPGFEAANDVPRHLRVSVNGRWTRVDAPYGSVYHSSGLGLSVF

SEQ ID NO: 6191 - protein, 155 aa, Corynebacterium glutamicum
MAANNVNDDTQNNLHVTEVDLRWADFDRFGHVNNAAFIEIAQEARLAFAEDQFRERGYEIPAVFVRHLEVDYLRAILPDTTQAVVETQVTKIGNTSFSTRQEVKDRNGRVCCVVECVQVAVNVQTAAPRSISKVERKVLTAVATDEVQSQEALEK

SEQ ID NO: 6192 - protein, 207 aa, Corynebacterium glutamicum
MTDNSLVGKRLWNYPDFLARAFYQDQSTRTIATASWPVLADPHGLGPIIHPRMEQQFAGLHNVIVRDGETLGYERIDAEIASIATAALRQKGFDAGFVYFGEIDDAGHIFGLAGDEYRDAIRRVDTHVKKVLSEVSRRSDELGEDWLVVITTDHGHLDEGGHGGTTDRERESWIITWSPHRELPEWPEEIAPHELAELMLVERRTLR

SEQ ID NO: 6193 - protein, 54 aa, Corynebacterium glutamicum
MLLLGLHGVRWDIIAEDGVGEFLQETAQQGAFRIMVMEPPTLSGPGWSSILTGY

SEQ ID NO: 6194 - protein, 556 aa, Corynebacterium glutamicum
MGEFIYTMKNVRKAIGDKVILDNVYMSFYPGAKIGVVGPNGAGKSSILKIMAGLDQPSNGEAFLDPGATVGILLQEPPLNEEKTVRQNVEEGLGEIFEKKQRFDAIAEEMATNYTDELMEEMGVLQEALDAADAWEIDSKIDQAMDALRCPPSDEPVTHLSGGERRRVALAKLLLAEPDLLLLDEPTNHLDAESVLWLEKHLADYKGAVLAVTHDRYFLDHVAQWICEVDRGQLHPYEGNYSTYLEKKAERLEVSGKKDQKLQKRLKDELAWVRSGAKARQAKNKARLQRYDEMVAEAEKYRKLDFEEIQIPTPPRLGNKVVEVKDLEKGFDGRVLIKDLSFTLPRNGIVGVIGPNGVGKSTLFKTIVGLENPDAGSVEIGDTVQLSYVDQGRENIDPEKTVWETVSDGLDYIIVGQNEMPSRAYLSAFGFKGADQQKPSKVLSGGERNRLNLALTLKQGGNLILLDEPTNDLDVETLGSLENALQNFPGCAVVISHDRWFLDRTCTHILAWEGNIAEGQWYWFEGNFEDYEKNKVERLGADAARPSRVTHRKLTR

SEQ ID NO: 6195 - protein, 205 aa, Corynebacterium glutamicum
MINTPVTIAGRIVSDSVYIGRKDNLDGVLRIRVASSRSYKQGEKWHNVDKVFINVEAWGKLGVNSHISLKPGVSVIVQGFLYTNEWEVESADPNVKKLEKRQEIRMRATSIGIDMNHYIVGFKESKPNASNSPEGVEMPDANLEDYPDVDQKRGAKQVAASDASEEGTEASEADEAPETPEEKRELAMAGVGAGSGSDSGEEAPF

SEQ ID NO: 6196 - protein, 701 aa, Corynebacterium glutamicum
MNKSQVKSSKVRITWPFYVLFAFVAGLVGVILAWGFLSESLAALGIPDPGPMTTAGLPFLRAVGWIVAALSAGSFMATTFFISPREIKRSAEDGPQKASYLNRSYLSVDGSIAARTGSFAAICFGLVAIVMIPMVMSDLSGQPFTEALKLQNWAIAFEQVALAKAWAWVAGFAFITGIAGLFCRTWLAQPLLFAGSIIMTVPLGLEGHSAAGGDHDYGTNSLLWHLVLMLLWVGGLMALIAHARRIGPNMDMAVKRYSIIATYAVIGMAISGVVNALLRMDFSDLFTTNYGLLVFAKAVGVVVVGMFGLAHRTFTIPKLEKDPKNSALFTRIAIVEVLAMAAVTGVAISMGRTPPPAPEIQDLSVMALEMGYSLEKEPTLLNVFTMWRFDLMLGTIGIMLLAFYMYGLVALRRQAKKWNHMRTFWWVLGCITLVVTVSSGIGMNMPATFSMHMVAHMLLSMVVPVFLVLGAPLSLIMEAVAPGEPGRPGLHEWAAVMTDNPLLKFIMHPAVNTIQFIIIFYALYLTPLYDIMVSEHAGHLIMNFVFVISGYVYYWEMIGPDPKPEERTHVSRLAWLTFSMPFHLFFGVYLMQLQVILAEDFYTKLNLPWEVDLAYDQLVGGGIAWASGSFPLIVVFGYLFRGWFREERIVEKNYQARAEATGYADAEEYNRMLARMNEGHDMHGDYYQETFEPKDKDKDKE

SEQ ID NO: 6197 - protein, 473 aa, Corynebacterium glutamicum
MSFKRRSLAITCAITSSIVLAGISGTAAAQSSYVSGSSGLLSSSELHPETPAPLDAPKNIIYMIGDGMGYNHVSATNLFETGQTMHQVEGEPGSVTPVEGGTPVQAFEGAEWTQLAQSTFQDGNSYDPERAWADHNYVNENFTDSAAAGTAMATGVKTTNGMIGINPANEPAKNTSEYAIEKGKAAGVVSSVPFNHATPAAWAAHNSNRNDLHAMAEEMINSDLNVIMGAGHPFFDNNGNPITEADEDYMQASQYERLASGETDFTFVEEDADFEALANGQVESDKYFGLAQVEDPLQHDRDGDSVTPYDVPLNDVVDLSTMSKAALNVLNQDEDGFHIMIEGGAIDWAGHANDMARDIEEVQEFNKAVETVIEWVETNSSWDETLVIVTADHETGYMTGPNDDPNWSAMTGAAGIVPNHGWHSGNHINQLVPVFARGAGVSDIVAAADQVDPIRGNYIDNIEIANLTFNKWW

SEQ ID NO: 6198 - protein, 310 aa, Corynebacterium glutamicum
MRFMVLSYRNLLTLHGTGSHTFDDVPLRGEVEDDDGDDGQDQHGHHGTRIAVTVGANEGLDDHRDGLVSRGQANDQVWQQVVVPHPHGIENGHGDGSWLEHRPDYPEVVLERTTAVDHRSFLNIQRNGLDEARKHEHRQTGTETEVEHHDADRVVEVEHVCNLDRREHDHLEGDDHGDHEEVVQKVCPPGLDARDVVGGHRGEEHDDDDGEDRDDEGPQCGLQEALLGQAHHEVLEADPGFTDGKGERIGGDGELGLKGVDEDEEDRPQEDDGEERQNGVDHELGAARHVGLIIRGKLVILLLRGRSGLR

SEQ ID NO: 6199 - protein, 213 aa, Corynebacterium glutamicum
MNRILGPESKFYAALSLFADLVIVNVLLVITCFPVFTGGMSLRTAHAVTGQMVREEGSRRGSAFVRGLLTRPGVNTAWWLISLAVAALAAYEFAIIAKADLGSMGLILRAALISGLIVLGSVSVWFFHLDAPGLGFRQRITQAMMKAVGHLPRTLLAILPGIVLVLYPVFFPAQWGGYLFFLAVLGPALAVYLAELVLQWPELNSQTPDSPSA

SEQ ID NO: 6200 - protein, 304 aa, Corynebacterium glutamicum
MTTSTSAQAAPASKKKDHQLPSDNKTHMSGSAKFVVYAILAFFTIVFLGPILFIFINSFKSKFAISSDPFSLPIGETWVGFENFMVGLTKQGFLEATLWSFIITILSVIVIVFFSAMTAYYITRVKTWWTNLLYYLFVVSMIIPFQMVMFPTVKIADMLHLNNPIGIVVLYLGFGSGLSVFMFAGFVKSIPLDVEEAAMIDGCGPLQNYFRVVWPMLKPTAITVAILNAMWVWNDYLLPYLVIGLSTRYKTIPVVIQSFVGSNGNRDTGAMMAMLVLAIIPIVIFYFSTQRHIIEGVAAGAVKG

SEQ ID NO: 6201 - protein, 281 aa, Corynebacterium glutamicum
MQATLKKYFPVFVLPTLLAFMIAFLVPFIVGFFLSFTKFTTITNAKWVGIDNYVKAFSQREGFISAFGFTVLVVIVSVITVNIFAFLLAWLLTRKLRGTNFFRTVFFMPNLIGGIVLGYTWQTMINAVLSHYATTISADWKFGYAGLIMLLNWQLIGYMMIIYIAGLQNVPPELIEAAELDGVNKWEMLRHVTIPMVMPSITICLFLTLSNSFKLFDQNLALTNGAPGGQTEMVALNIINTLFNRMNVEGVGQAKAVIFVVVVVVIAYFQLRATRSKEIEA

SEQ ID NO: 6202 - protein, 558 aa, Corynebacterium glutamicum
MWNNCSRTSSRRGPQPSPTPLPALRYWKECGEGDGNRALAPVGFLLSSPVVIEVLDDVLPLQLSGGVLRQILAEVILELLGREVLEVPRVGGQILVSDSFRDLLRKGVIRGVLSGVAFERCDEAKVLHHVLLASFRGKQPIHEVLGGLLVDLGGLRVHAQIVLGTDVDAVLFFIWQTHVHGQELDLVFLDHVARSLGNLGPCPVTVLNHSGLALCELSHGIRHRLRRRKRLFYGGVLKVEIEKVLVLLVVGELDLVGVLDSLVLVLLPDRSVGQVGLPTPVLTGCQRGGGEGAFDTELVLLCLHILGDFLELLVARDLIRGLDLCAGRGDVLVEDLVVVDDAEALDGERNATYLAILGGQRRNVVGQLLSYLGVRHICHVVLPSDEAGWAIDLEESRGFVLANLGLEGLLIGAGGGSNDLDLNAGLFSVGLCDFLVCHVLFRLEVQEVNIAFLVGGAGARDETCGGEHGGHADGCDASKTLQEVLIFLDKKRGDEPRWISGPYSIVSGRPPITKASSQRHQVLHSGLQSDYELVSLPSTLVRYSTYSQVIGPKTYKYI

SEQ ID NO: 6203 - protein, 443 aa, Corynebacterium glutamicum
MKRLTRIASISMASMLAAASLVACSGSTDEEGDVYFLNFKPEQDVAYQEIAKAYTEETGVKVKVVTAASGSYEQTLKAEIGKDEAPTLFQVNGPAGFITWQDYMADMSDTEVAKQLTDDIPPLTTEDGEVRGVPFAVEGFGIIYNDEIFDKYIATSGAKIKSTDEITSYQKLKEVAEDMQAKKDELGIEGAFASTSLTSGEDWRWQTHLANAPIWQEYQDKGVEDTNEIEFSYNKEYKNLFDLYLENSTVEKSLAPSKTVSDSMAEFAQGKAAMVQNGNWAWSQISETSGNVVKEDKIKFLPMYMGLPDEEKHGINVGTENYLGVNSEASEVDQQATKDFVDWLFTSEAGKEHVVKDLGFIAPFESYTAENTPNDPLSEQVAEAIANKDLTTYPWNFQYFPSQQFKDDFGQDLSQYASGKLKWEDVVKHFNDNWAAEKESNWG

SEQ ID NO: 6204 - protein, 414 aa, Corynebacterium glutamicum
MKESMSITSSTYASALLTLPWGTPLEQWPDNLIAALPRGISRHIVRFVGINRGIVAVKEIGARTAHHEYKMLRELQRLGAPSVRPVAVITGRHPAEEDYGELTAALVTEHLEFSLPYREIFSRHLTVVESEKLIRALSVLLVRMHLLNFYWGDVSLSNTLFRRDAETYSAYLVDAETGEFQPNLSESRRLYDVDIARVNIIGELMDLQAGECLDKSIDVIALGGLVESSYLELWTELTAEESVDASEYWRLSERIDRLNQLGFDVGELKVTKDDSRQVVRIRPVVVDPGHYRAELLSLTGLSVEEHQAQRLLGSIQAYQAVECGPHVGLTQAAHLWMTNEYEPTIAAVPVEMLDKLEPAQIFHEIVDHRWFLAQERGGAVTLPEATASYLESVLPARRDEARLLSTNPSDEDLS

SEQ ID NO: 6205 - protein, 376 aa, Corynebacterium glutamicum
MATVTFKDASLSYPGAKEPTVKKFNLEIADGEFLVLVGPSGCGKSTTLRMLAGLENVTDGAIFIGDKDVTHVAPRDRDIAMVFQNYALYPHMTVGENMGFALKIAGKSQDEINKRVDEAAATLGLTEFLERKPKALSGGQRQRVAMGRAIVRNPQVFLMDEPLSNLDAKLRVQTRTQIAALQRKLGVTTVYVTHDQTEALTMGDRIAVLKDGYLQQVGAPRELYDRPANVFVAGFIGSPAMNLGTFSVKDGDATSGHARIKLSPETLAAMTPEDNGRITIGFRPEALEIIPEGESTDLSIPIKLDFVEELGSDSFLYGKLVGEGDLGSSSEDVPESGQIVVRAAPNAAPAPGSVFHARIVEGGQHNFSASTGKRLP

SEQ ID NO: 6206 - protein, 250 aa, Corynebacterium glutamicum
MQHVQVRILSSELVCSLSGAIRGVNLDIAAPKPKKSGRRTLTKPEWDAVIKHLLTRDTEPLLTPTKHKNIRQSTKNIHARIVRLTLLQAVSGLRIAEANQLQWKHIIDGDDGMLINASADIVKGRKGKERGRYIPILRADVAEYLRTHREDDEHFIVGSPTTTARPWDATNADDKVPELYRQIAEATGVKTLQDLRSHSWRATLHGVYADVMDPATRAAIFGHTEQVAEEYYNDRQNIESLMRQVKRAYA

SEQ ID NO: 6207 - protein, 228 aa, Corynebacterium glutamicum
MLHREGKGGLLGAYIAGFEWGLEKDYHVLCEMDADGSHAPEQLHLLLEEIEKGADLVIGSRYVPGGETVNWPANRELLSRLGNKYISVALGAGINDMTAGYRAFRRELLEHLDFEELSNAGYIFQVDVAFRAIKDGFDVREVPITFTERELGESKLDGSFVKDSLLEVTKWGVAHRSEQISDFTSEVSKIASRTVKDMELGPKATTAKNAVPDFVSEVSNLAKGTFKK

SEQ ID NO: 6208 - protein, 230 aa, Corynebacterium glutamicum
MFLIKRPGLLCCLWPVFGHIWATTAVRSAIAMKSLIILFEALIIGLSDLPLPRGRSFIQWRQNSDLPVIPSADELVHVPLVRCSALMIPSDISPDTMTGCCDDLHDCPCNPDSLVLVKSTGKELFGLVGIGYRDSQFRKLDQRRHRVEIRDSLRITIEQGTGISVKNSRAMLYALINSTLCPQRQVKRFFAYRRPPPAPRLRCPQAALLIYPRRNSAGGTPYLARNSLVK

SEQ ID NO: 6209 - protein, 263 aa, Corynebacterium glutamicum
MQSQIWLSIPGEHHGLGFQCTYFNRVRFNACSVPAILNVVTLPKAEFLSSPCTRSVEAQFTSPLLNNGQTCFLGTRILAPKSRYAEVVDAFTAFAGSLQVGVTSSPDTQIGPMATARQRERVESYISQGKNAGARITVGGSRPRDLDAGFFVEPTVFADVDNRAAIAQDEIFGPVPSVVSYQDDEHAIQLANDSEFGLGGTVWTSDPERGAALARRVHTGTIGINRYIPDPAAPFGGVKNSGLGRELGPEGLASYQETQTIYL

SEQ ID NO: 6210 - protein, 254 aa, Corynebacterium glutamicum
MRHTDAIVRDQIYPTFLPAVFGHEGAGVVVAVGSAVTSVKPDDKVVLGFNSCGQCLKCLGGKPAYCEKFYDRNFACTRDAGHTTLFTRATKEQAEAIIDTLDDVFYDADAGFLAYPATPPEASGVSVLVVAAGTSDLPQAKEALHTASYLGRSTSLIVDFGVAGIHRLLSYEEELRAAGVLIVAAGMDGALPGVVAGLVSAPVVALPTSVGYGAGAGGIAPLLTMLNACAPGVGVVNIDNGYGAGHLAAQIAAR

SEQ ID NO: 6211 - protein, 115 aa, Corynebacterium glutamicum
MSLTTCSDQGDTHRARRLLEPEPQTESGDRKAFTASHPPQVARSFLNSTAEVVVLILADRLLENGRSCLNSPCGSGSGVLNIRCICAAVDTAAVAPPPLITTLSSMLNSACINVP

SEQ ID NO: 6212 - protein, 394 aa, Corynebacterium glutamicum
MGLWIDATAGVAGDMLLGALIDAGAELEKIQQVVEAVIPGDVLLRTEEVVRQGQRGIKLHVDAQHEHHHHRHLSTIKELLVNADIPEQTKQDALGVFELIAIAEGKVHGIEPEKIHFHEVGAWDSIADIVGVCEAIRQLNPGLIAASPIALGFGRIKAAHGDIPVPVPAVAELVKGWPTQTGALMESTEPVGELATPTGVALIRHFATQDGPFPGGIINEVGIGAGTKDTEGRPNIVRAILFNTSRSNPDTRTLVQLEANVDDQDPRLWPGVIEILFAAGAVDAWLTPILMKKGRPAHRVSALVDSSEVEAVKTALFAATTTFGIRSWEVEREGLDRRFEQVEVDGHTINIKIGSRDDQVISAQSEFEDIRSAAVALGISEREVVARIPQGTTE

SEQ ID NO: 6213 - protein, 250 aa, Corynebacterium glutamicum
MSRFAANLSLTFTELDFLDRFDAASKHAFSAVEFQYPYDFDVQEIKQRADSAGLPIELFNAPPGDTFGLAALASPEDFQQSIEQAITYATVLKPKKMHVMAGIADVTSETTARYVENIRWAAQQLDKLDVVVVIEPINHYSVPGYFLHTLEQAYWLIDSIAHPNVKILFDTFHLQQIHGNLTRRLREVHGAGLLGHVQVASVPDRHEPGTGEVNAAYIFQLLSELGYDGVIAGEYHPAGETTAGLGWLEL

SEQ ID NO: 6214 - protein, 266 aa, Corynebacterium glutamicum
MALPLPSKSARALVTGASQGIGLAIAKDLARYGHNLILVARREDVLKEIAADLEKKHGVIVEVRPVDLSDEPARKVLIDEIKTREINIIINSAGIASFGPFKDQDWSYETAQFSLNATAVFELTHAVLGGMIDRGTGAICNVGSAAGNVPIPNNATYVLTKAGVNAFTEAMHYELRGTGVACTLLAPGPVREAEIPESEKSIVDKVVPDFLWTTYESCSAETLRALSKNQRRVVPGPLSKAMNFVSSVAPTAVLSPVMGWVYKKMG

SEQ ID NO: 6215 - protein, 219 aa, Corynebacterium glutamicum
MSESENNTTPAVAARDDRLVWVDLEMTGLDLKRHVIVEVAALVTDANLNVLGEGVDLVVHATEEELAQMDDFVTNMHESSGLTEQIRESAVTLKEAEDAVLALIEKHCDPAHPAPLAGNSIATDRAFIREHMPRLDEALHYRMVDVSSVKELARRWYPRVYYKQPEKGLAHRALADIVESIRELDYYRRSFFVAEPGPTSEQCADDAQAAVDRFAPYFD

SEQ ID NO: 6216 - protein, 396 aa, Corynebacterium glutamicum
MELSPTVPPQTPKRHMRIQSPMEISWSEAVREGGEHSARRCGDMAVSALAKPNPIIDDDPEGNPDVCMYTWIVECPGATAVLLWINGVFDHERIEESEMTRLEGSDLWILSLRMPSDWRASYTVNAWSGDGVAPWREAGDRMHIRKAAMSGGRPDSRAMGHIMDSSLVEGPDALPDCWVAASTSVKVVEETVAGEHFWFYEAPVKAPLLVLFDGQHWNNSMNLPAQVDAAIAIGLLPPVSLLMIDSVNTERRWDSVGVPGGQVDVLIDALLPHVRETYNVSARGEDTIVTGASFGGLASLWALALSDGEVGHAIAQSPSLWRFNVADALSAAEQWSSIHLQAGKYEGEMLRLSHQLAEDLSGDIREVRVRGVHGGHDWAWWRVHMLTELTRLLKTL

SEQ ID NO: 6217 - protein, 403 aa, Corynebacterium glutamicum
MRVFRGRRGAVAGSFLAVLAIGSLALTGCTIERSDAQEQSSQQSTEVEAEEAQAPVISVDDGDEDVDPSESVIVKSMGDGLSKVTMTNEEGYEVESELSDDGRSWTTAETLGYNRTYTIKATDKNGETATASFSTATPAATTNVALSPLADSVVGVGQTIGFRFGSPVKDRKAAQDAITVTTSPKVEGGFYWLNNSELRWRPAEYWEPGTEVTVEADIYGKDLGGGVWGETDNATNFTIGDKVEAVADDATKTMSVYKNGELLRTMPVSFGRDTSEWATPNGTYIIGDRNESMIMDSTTFGLGYEEGGYRTPVKYATQMSYSGIYVHAAPWSVGAQGSYNTSHGCINVSTENAQWFQEAVKRGDIVTVKNTIGETLSGYDGLGDWNIPWSEWSKGNADQTSAW

SEQ ID NO: 6218 - protein, 215 aa, Corynebacterium glutamicum
MNSHWSGITDPEKLHSGFVDLVDQLADQSRDGNWDAILQLLGTHANLSPNQWRIGGTSWFTPLHQTAWLGAPVEVVDELINQGAWCSLRNADGDRAIDIARSRGHSHLLDALHVRDLNEPEREKFQAWDQHLADLIVQRTKSLGPVNFRPVPTEVITLEELESLWFGYPGMYGGFLISIHRDRLFIESWSRVVGGSGQAHVITKGGCVLVEEGFV

SEQ ID NO: 6219 - protein, 50 aa, Corynebacterium glutamicum
MTFLTLTFNLDNPSFLTPPQPPVAEPALAEQEEEIVTEQQQLETGESDRT

SEQ ID NO: 6220 - protein, 82 aa, Corynebacterium glutamicum
MLKRQQFSYIYIFLTIWHYWGHYETLDPHENYMRLRLFQEDVITECSIYEFLWFFGIKDALTLREQFRVWSTTGALKWLFLF

SEQ ID NO: 6221 - protein, 436 aa, Corynebacterium glutamicum; identical to SEQ ID NO: 4687

SEQ ID NO: 6222 - protein, 69 aa, Corynebacterium glutamicum
MKSDEAWIAGYKAAAPFLLIAAIGIVASGVASIFVPFDAVATVSMIGTAWMAIFLGLGAFKATQAAKSV

SEQ ID NO: 6223 - protein, 213 aa, Corynebacterium glutamicum
MKKKLMLPLIVAALGLSACSSEPAAAPLEAEPLHNLLIDGSESGLDNATEGNDTSLSGQPINLTVVNGALDIDGSCGKALQAVEDVNLDSVASASRALASGDKQVGIAMYSTAEDNDISPMDLYADIANACEDPVVDSSDTTYTFGKLDDAPDGAVGFTLDIEVTPDNQGSTVMMIQELGNHHIIVAGLETTPEETATVFEAQRTKLEEGLAA

SEQ ID NO: 6224 - protein, 151 aa, Corynebacterium glutamicum
METQAFQRQNTGLIAMVAADASNPFFLEIFRGAQHAASTQGYTVALVDARESAIKSREVLDKIVPHADGLLLAASRMDSGEIHKVAREIPTVLMSREVQGIPSVMVDNYDGAPKAVVHLVDQGCRSITYIAGPNKSWADATRWHRLAGGCR

SEQ ID NO: 6225 - protein, 543 aa, Corynebacterium glutamicum
MGDDLVQHLPGLNRRLPGVDKRNRIALSACGVLRAPENFQEEGIRRIGGNHSDEAGVLALKSLSFHTRCGFSPQWKNSLAQAAKTPATQWKGRRQRLLRHHKWWLLSRCEPQNLSCTRVYSAKEITSLDSMLTMPIPEYLHEILDDVRDTTSGELADYIPELKSADPNPLAVALCTVNGHIYSAGDDDIEFTMQSISKPFAYALALQECGFDEVSASVALEPSGEAFNELSLDGENRPMNPMINAGAIAINQLINGSDSTVEDRVEKIRHYFSELAGRELTIDRVLAESELAGADRNLSIAHMLRNYGVIEDEAHDAVLSYTLQCAIKVTTRDLAVMTATLAAGGTHPITGKKLLDARVCRLTLSVMASAGMYDEAGQWLSTVGIPAKSGVAGGLIGILPGQLGIATFSPRLNPKGNSVRGVKIFKQLSDDMGLHLMSTEQVSGHAVRSITRDGDTTFIQMQGAMNFSASESFLHAIVEHNFEGTEVVLDLTRVLSFHPVAIRMIKEGLKRIRDAGFEVFILDPDDVLPDFMFSDGTICKERV

SEQ ID NO: 6226 - protein, 159 aa, Corynebacterium glutamicum
MRVASTSAISISRSVTVQPGRMRHLIKPKMKTISVDSPDFVGGRRAFEAWSKDRTDAVICFNDMVALGFIQQARLSGVRVPHDVAVVGFDNTENSVLSTPSLTTVAGPLRAVGRVATANLIALLKGMKAPLMAKPRELPTRLIVRESSLKTAVDLKRSS

SEQ ID NO: 6227 - protein, 185 aa, Corynebacterium glutamicum
MLQPGRFYYELRFKSTAVFSEDSRTMRRVGSSRGFAIRGAFMPFNRAIRFAVATRPTARSGPATVVRDGVLSTEFSVLSKPTTATSCGTRTPESLACCMKPSATMSLKQITASVRSFDHASNARRPPTKSGESTEIVFIFGLIKCLIRPGCTVTLREIEIALVDATLNGSRQRACASAWHQPRIY

SEQ ID NO: 6228 - protein, 518 aa, Corynebacterium glutamicum
MTTSHASHPDRLLPADPGTRDIARRLLAHVEDLPIISPHGHLEASMFVKDEAFPDPTSLLISPDHYLTRMMHSAGVDLADLRVGGHEGKSAREAWRIFMSHWDLYAGTATGYWVEQEFEHVFGINAERLNVGTPEHADAIFDELTDILAKPDFRPRALAEQFNLEVLATTDDPLDDLADHKALADDPTFSPRVLPTFRPDAYTKMYNAGWAEKTTKLIDTAGDGKAGWEGYLQAMRNRRQYFINHGATSADHGLHDTDTTPLSHKDAQKILDKGLAGTATLAEMHAFEANTTYRFAEMSQEDGLVMTIHPGVYRNHSASAQKKFGADIGADIPFQMEFTNGLRPLLSDFGENKDLISDSSFNRWLRTVSLGSTQDADMAAASNLAANSKMARQNTRDILDAVSDGGVMLGRNGALVLGPVVGTLHIKFIAPLNKRVERVMYKTGLSEAAAAEQCALEDRLREEMAHALYQWNPGRDENYDLVINTGSMTYEQIVDLVVETYARKYPLHVRIIPNGKDQ

SEQ ID NO: 6229 - protein, 167 aa, Corynebacterium glutamicum
MSAAEGLHIVVMGVSGCGKSSVGKALAAELGIEYKDGDELHPQENIDKMASGQALDDDDRAWWLVQVGKWLRDRPSGVIACSALKRSYRDLLRTKCPGTVFVHLHGDYDLLLSRMKAREDHFMPSTLLDSQFATLEPLEDDEDGKVFDVAHTISELAAQSAEWVRNK

SEQ ID NO: 6230 - protein, 399 aa, Corynebacterium glutamicum
MARTHESRGILMTTDIYFSHNNPHDPYAHHTTELNRDTHHLWVTLTTDSNDFDADSFTTEVIRITGYSRHEVNNGLNAMAAMTNLPHLRAIQERYYFLSIRYLASIMIAVAKADPTLWEELDLRITDALTPVTAGEVMIQSSTLSKRIAAWIKELDPEPTPEPTPKEDYVHVHTTDEATYVRIKISGPNRLILNDIITQLKDTDTEDSLPEALMAFLTEKIQLKITKYLFTPHKHPEQVWSPDYGDIDPEAYANATLVCAKDLDELAGATEKSYTPSEKMKALIRARDGHCRFPGCCVPASKCQVDHIIPWAEGGPTAAWNLQLLCQRHHNMKTDGRFTADANGLAEIRWIGPMDVPAVTRPTGPLVKAMPRGIWGQVLRDRIQARFERIRDRALNKED

SEQ ID NO: 6231 - protein, 186 aa, Corynebacterium glutamicum
MARALILVDVQKDFCPGGSLATERGDEVAGKIGAYQLSHGSEYDVVVATQDWHIDPGEHFSETPDFKNSWPIHCVADSDGAAMHDRINTDSIDEFFRKGHYTAAYSGFEGTAVSEELLMSPWLKNKGVTDVDIVGIATDHCVRATALDALKEGFNVSILTSMCSAVDFHAGDHALEELHEAGAILI

SEQ ID NO: 6232 - protein, 91 aa, Corynebacterium glutamicum
MARNIEDIQRDIERTRRQLASTLDELADRSKPSNLVDDAKNQATAKLQESNVQKVLLGVAAVVVGAVVFSVVRGRKKANDLKEIQRLLSER

SEQ ID NO: 6233 - protein, 155 aa, Corynebacterium glutamicum
MKRLDVGDTPPAFSLPNDSGSTTSLSDFAGKQVLVYFYPKANTPGCTKEACDFRDSLSNLNDLDIAVVGISPDPVDKLVKFREDHELNFPLLSDEDKSVMTAWGAFGEKKNYGKIVQGVIRSTFLINADGTVGMAKYNVRATGHVERIVREITAA

SEQ ID NO: 6234 - protein, 212 aa, Corynebacterium glutamicum
MEAAGTEILMPRRRPAQQRSRERFNRILTAARSVLVDLGFESFTFDEVAKRAEVPIGTLYQFFANKYVLICELDRVDTAEAVAELKKFSDQVPALQWPDILDEFIEHLARLWRDDPSRRAVWHAIQSTPATRATAAATEKEMLEIIAEVMRPLARGAGYEERMSLAGLLVHTVSSLLNYAVRDVNSSEEDFDSIVEEIKRMLISYLFSVATG

SEQ ID NO: 6235 - protein, 135 aa, Corynebacterium glutamicum
MISIGTDLVHISAFAEQLAQPGSSFMEVFSAGERRKANERQASRYAEHLAGRWAAKESFIKAWSQAIYGQPPVIAEEAVVWRDIEVRADAWGRVAIELAPELAAVVRESIGEFSSSLSISHDGDYAVATCVLTIQ

SEQ ID NO: 6236 - protein, 475 aa, Corynebacterium glutamicum
MSSSSNPTTEQVGIPRNVVIILAVLVFTAFVMMLNETTLAVALPSIMADFDIEANTAQWLLTGFMLTMAVVLPATGWMLERFTTRSVFIFATVVFLIGTVTAALSPTFAIMLAARVAQAIGTAVIMPLLMTVAMTVVPPERRGAVMGLIAVVMAVGPALGPSVAGFVLSLSSWHAIFWVMVPLVFVASLIGTLRLTNVSEPKKTPLDVISFLISAVAFGGLVYALSSIGIILEGDRSALVVLAVGIIALVVFVWRQIAMGKQDKALLDLRPLAIREYTIPLVVLLTLFGALLGVMNTLPLYLQGSLMVTALVAGLVLLPGGLLEGVLSPFVGRIYDRHGPRGLVIGGMSLVVISLFALSTVDEFANVWFIIGVHIVFSIGLALLFTPLMTVALASVPDNMYGHGSAILNTLQQLAGAAGTAVMIAVYSTVSNNALIDGATQQTALADGANSAFFASACVAVFALIVGFFVKRPAR

SEQ ID NO: 6237 - protein, 108 aa, Corynebacterium glutamicum
MTSTNKQMRKAVIFLLFLLGLVIGFFLRYSLVPLESVLEQKLLWLLGFFIHQAILFSVVVGTAIVLYRYRRGHYAIRALGWGIWAGFLISNLFFMALILAVALGGLTP

SEQ ID NO: 6238 - protein, 138 aa, Corynebacterium glutamicum
MVAMKYNVDVSRESEDWLATVTNLEGVSTWATTFANLDRNGREAIALAEDLPEGAESSLTISWSVPTDSHPELDTAIQIAQQRRYLVQAQQDLEPKVRSAISALTQAALLGMTAGRVSPTHNPGSRAISLDQVSGVLN

SEQ ID NO: 6239 - protein, 2993 aa, Corynebacterium glutamicum
MSRNFGASRLINRFGQEPFAFAFAGQGYDWLKTLRAAVAAGAGTNVSDIVERANALLALVADDLIGTLPFGFDPVAWANNSEDPAFDTAQSAVSVPGIFVSQIATLDSLEAQRLDVDQAVSSIGHSQGVLGVHLLNDATRADELVAIAQLIGAAITRTARMTGLIAQGDNMPMLSIAGISREQLQQAIDAACAEVPAEIRPVIGLRNSRDSYVLVGRPDDNARVVKVIEAMAAKDKKAIEDKLRGGSAFSPRITPLKVQAAFHHPAMNMAVEQTVAWATTAGLDVELTREIAADVLVNPVDWVARVNEAYEAGARWFLDVGPDGGIVKLTANILEGRGADSFYVGDAAGQAKIFDAGMAPELPVDYQEFAPRVEHVDGTPRLVTKFTELTGRTPMMLAGMTPTTVDPAIVAAAANGGHWAELAGGGQVTPELLETHIAQLTDMLEPGINAQFNSMFLDPYLWKMQIGGKRLVPKARANGASIDGIVITAGIPEKDEAVALVKELMRDGFPWIAFKPGAIKQVNSVLAIAKEVPELPIIIQIEGGVAGGHHSWEDLDELLIATYGKVRALDNVVLCVGGGIGSPERAADYVTGSWSTSYGLPAMPVDGILVGTAAMATKEATTSQAVKELLVSTQGSDEWVPAGGAKNGMASGRSQLGADIHEIDNSFAKAGRLLDEVAGDETAVQARRDEIIEAIGKTAKVYFGDIGSMTYEQWLNRYLELSGPVDGQWIDASWAARFAQMLERAEARLIEQDHGQFEPSLTVEDGVDKLVAAYPHAATDLLTPADVAWFLGLCRTPGKPVNFVPVIDKDVRRWWRSDSLWQSHDDRYTADQVAIIPGVVAVAGITKANEPVADLLDRFVDATIERIDEHDSRSRDIMGKVLSSPGTFWAGRNIPSVIHSLGHADKWSRSEFEAFHSPTGANLVYEDAEHAMLTVPLAGSTAFGTTAELKIRFTSPIDALPSAVPLVTQEDAEAAMGELTRIAAGGTLATVNNGTATWETSVDAGVIADYNNVTAGYLPASVVPAHTAPDVLVGRAWPAVFAAVKSAVIPGTDSASVVEGMLSLVHLEHHIVLKSDVPTDGALKVSATADEVVDTDLGRLVIVRAEIADAEGNLIATLAERFAIRGRKGNAVARTNTSALPTTVDTPRSARAVATVVAPESMRPFAVISGDRNPIHVSDVAASLAGLPGVIVHGMWTSAIGELIAGAAFNDEQIQTPAAKVVEYTATMLAPVLPGEEIEFSVERSAVDNRPGMGEVRTVTATVNGNLVLTATAVVAAPSTFYAFPGQGIQSQGMGMEARRNSQAARAIWDRADAHTRNKLGFSIVEIVENNPREVTVAGEKFFHPDGVLYLTQFTQVGMATLGVAQIAEMREAHALNQRAYFAGHSVGEYNALAAYAGVLSLESVLEIVYRRGLTMHRLVDRDENGLSNYALAALRPNKMGLTADNVFDYVASVSEASGEFLEIVNYNLAGLQYAVAGTQAGLAALRADVENRAPGQRAFILIPGIDVPFHSSKLRDGVGAFREHLDSLIPAELDLDVLVGRYIPNLVARPFELTEEFVASMAEVVESTYVNEILADFKAASADKQKLARTLLIELLAWQFASPVRWIETQDLLIKGLQAERFVEVGVGSAPTLANMMGQTLRLPQYADATIEVLNIERDRPVVFATDEVVREVAVEETPAAPAETTETPATPATPAPVAAAAPATGGPRPDDISFTPSDATEMLIAIWTKVRPDQMGATDSIETLVEGVSSRRNQLLLDLGVEFGLGAIDGAADAELGDLKVTVSKMAKGYKAFGPVLSDAAADALRRLTGPTGKRPGYIAERVTGTWELGQGWADHVVAEVVIGAREGASLRGGDLASLSPASPASASDLDSLIDAAVQAVASRRGVAVSLPSAGGAAGGVVDSAALGEFAEQVTGHDGVLAQAARTILTQLGLDKPATVSVEDTAEEDLYELVSKELGSDWPRQVAPSFDEEKVVLLDDRWASAREDLSRVALGELAATDIDVTGAGEAVAAQAEFFGLDDLAAQARDQSSLDYADDVAVVTGGSPNSIAAAVVEKLLAGGATVIATTSNLGHDRLEFYKDLYARSARGTAALWIVAANLSSYSDIDAIINWVGSEQTTTVNGASKLVKPALVPTLLFPFAAPRVSGSMADAGPQAESQMRLLLWSVERLIAGLAPLGSSINVGHRLHVVIPGSPNRGRFGGDGAYGESKAALDAVVTRWNAEQAAWGAHTSLVHAHIGWVRGTGLMGGNDPLVKAAEEAGVETYSTQEIAEKLLSQATSTVREQAASAPITVDFTGGLGESDLNLAEMARAEAAKAANAPVVEAPRTVAALPTPYRPVVQTTPDFAGQVTQNLDEMVVIVGAGELGPLGSARTRFDAELNGSLSAAGVIELAWTMGLIHWDEDPKPGWYDDSDDAVAEEDIFDRYHDEVMARVGVRKYNDMPEYGMIDNFAPELTTVYLDQDLTFNVGSREEALTYVDSEPELTFASFDEAAGEWKVTRKAGSAIRVPRRMAMTRFVGGQVPKDFDPAVWGIPADMVDNLDTVALWNIVCTVDAFLSAGFTPAELLASVHPARVSSTQGTGMGGMESLRGIYVDRILAEPRANDVLQEALPNVVAAHVMQSYVGGYGQMIHPVAACATAAVSVEEALDKIRIGKSDFVVAGGFDALSVEGITGFGDMAATADSAEMEGKGIEHRFFSRANDRRRGGFIESEGGGTVLLARGSLAADLGLPVLGVIGFAESFADGAHTSIPAPGLGALGAARDGVESRLAVALRSVGVSADEISIISKHDTSTNANDPNESDLHERIASAIGRADGNPMYVISQKSLTGHAKGGAAAFQMIGLTQVLRSGLVPANRALDCVDPVLSKHSHLVWLRKPLDLRAKAPKAGLVTSLGFGHVSALVAIVHPDAFYEAVRVARGAEAADVWRASAIAREEAGLRTIVAGMHGGVLYERPVERNLGVHGDAAKEVEAAVLLDSRARLVDGVLRAEG

SEQ ID NO: 6240 - protein, 394 aa, Corynebacterium glutamicum
MENVSSVTSDGSVADVHAERWQELLARLDADAPDIAEGTAAKLLATIPGYELVDAGPIRESSIRNTALIIRVINAGTEPKAEDLPEALRLADERIAQNVPLGSVLHGFRMSLGEILEHLVQLGPEYNIDPGRMLRWSTLMWAVNDAFSTRATRVYRDHEVATAIADSVRRSEWIGKAVSEGSELSELLWGAAMYDVPADTPLRALAATSPDHAKAETQIQKWTQRAGVRVLASVQPSVIVGIVIGEPKRNVDGPGFAVGLGRAEVLSKLADSYKDASLVLKAADNLKLNEVQRAQDLSWKLAIHASPRVTEILAQKYVKPLRESGEFAHEIVESLRAYVDNQMNIPAAARSIPVHVNTLRYRLRRFEELTGCYLEDTSTVIEVSWVLEVFGREL

SEQ ID NO: 6241 - protein, 205 aa, Corynebacterium glutamicum
MANLTILTSIKRILMLNIARNRNMKRRLAIAAFVATATATATMAPASAQTDYAGLSSGVADTVAEAAGVATTAVAPAATVARPANGTFTSGFGPRWGTFHNGIDIANSIGTPIYAVMAGTVISSGPASGYGQWIRIQHDDGSISIYGHMEYLYVSVGERVAAGQEIAGMGSQGFSTGSHLHFEIHPDGVTPVDPQAWLANHGIYV

SEQ ID NO: 6242 - protein, 154 aa, Corynebacterium glutamicum
MSEPGPSGVKEKKKVKASHIVFLLICFIAACALAWWQWSRFQSGSGTFQNLGYAFQWPLIGAFFVYAYRKYLQYENESIELENMEAKMMAEQGKTPVAQSEQEDSFVQLSHRPSLVEDDSVKEIDESFLPSRPTMDVEEFNRLNDPHARRRRKA

SEQ ID NO: 6243 - protein, 118 aa, Corynebacterium glutamicum
MSTTTPIHPERKKRVRQALTMFSIAAWVTGVFLLALVAEMIMKYIIGMDLPEWARFVPIAHGWVYIVFLMTTLNLGLKARWNPTRWVTTAIAGVVPLLSFFVEHNRRKEVTQTFQLNS

SEQ ID NO: 6244 - protein, 206 aa, Corynebacterium glutamicum
MKLLLASNNAKKLKELQRILDQAGLDSVELLALRDVEAYDEPIEDGRTFADNAQIKARAGVTHTGIATIADDSGIAVEELNGMPGVLSARWSGAHGNDTANNELLLAQMEHVPDERRNAAFVSVCVLALPDGQEFVQEGRWEGQLLRGPKGENGFGYDPLFIPAEEIDGQGRSSAELSAEEKDALSHRGQALRGLVEKIAQVAAAS

SEQ ID NO: 6245 - protein, 245 aa, Corynebacterium glutamicum
MTSSSSFSRFDGRAQDQMRAVKITRGFTSNPAGSVLVEFGNTRVMCTASVELGVPRFKRDSGEGWLTAEYAMLPAATAERNRRESMAGKVKGRTHEISRLIGRSLRAAVDLSQLGENTIAIDCDVLQADGGTRTASITGAYVALADAIKVLQERGVVPGSPLLAPVAAVSVGLVDGNVCLDLPYEEDSRADVDLNVVMTEHGEFVEIQGTGEETTFTRAQLNDMLDHAEKGCRELVAAQKAALGI

SEQ ID NO: 6246 - protein, 82 aa, Corynebacterium glutamicum
MVLFPTTFSFDRMTVGADDTVTITVRSGYGGENQLAVYEAGKTGSANVLGWSTLTIAGEIPVVPEDPETPVATGSTLGSVLD

SEQ ID NO: 6247 - protein, 231 aa, Corynebacterium glutamicum
MRLGFSTLAQLCNSTIHSDGTTNTEPDYASKAAHISDATVDQFVEFGGGQANINPDGSATVDWEGSFSINFYDGLVPFTITNPHLEVSVAGTGVLTGDLTSYAVEMSNPNEKTPLTDLYEDVTITTFGGVNLDPEGVVTSNPDYDGVIVDVPLDATSQVTSGAGWGAWPQGFLDFHFDTNLPSYWYSSDGAGDPKKAPMSFNVDFTNGPGLVNSQLLHRQVISMPETKAVS

SEQ ID NO: 6248 - protein, 194 aa, Corynebacterium glutamicum
MMTERGVPVDHTTIYRWVQKYAPELDKQTRWYRQVPDWQASSWRVDETYIRVGGTWCYLYRAITAGGQTLEFYLSPKRNVAAAKRFLAKTLRSNTTAGSPRVINTDKAPALAKAISELKAEGICPQTVEHRQVKYLNNVIEGDHGRLKRILGPKGAFKNRISAYRTLKGMEAMHSLRKGQGTMFDLTGTRTQTR

SEQ ID NO: 6249 - protein, 454 aa, Corynebacterium glutamicum
MRTENRRQCHNGVVKKNDHGTTGTSESFRIRGSIPDVPRETRWDRLWRPFWAIPAASVVAALVFGFLLPTWERGLSDAALKFVFEGGPDAAREVLGTIAASTISVTGLIFSITLVVLQLVSSQFSPRMLNGFLRNRIVQATLAMFLGTFVFSLTVIRYVWSEDEDITGFVPRASVSVAFLLVLGCLGLFLAFIRLITFSMRVANAISEIGEETMALAARIYPVQSDDAGPVQGPGWSPRPGDPREEIRVGSHGSLVWIDYRKLVSWSTEHQAVITVDRPVGDFLVEGQPLLRVWWDGELSDRDRRVLHSAIEVRTERELHQDVAFGLRQLVDIADRALSPGINDPATAAQCVQEIHRIFRYLVTVIEPSPYIADDDGRVRVVHQPQRIADMLYEVIREIHLYGADSAMIPRLLRTMVEDLVTAAADHSLPAVERARGILDDETDEDRDSDTANV

SEQ ID NO: 6250 - protein, 178 aa, Corynebacterium glutamicum
MPVDHTTIYRWVQKYAPELDKQTRWYRQVPDWQASSWRVDETYIRVGGTWCYLYRAITAGGQTLEFYLSPKRNVAAAKRFLAKTLRSNTTAGSPRVINTDKAPALAKAISELKAEGICPQTVEHRQVKYLNNVIEGDHGRLKRILGPKGAFKNRISAYRTLKGMEAMHSLRKGSGNDV

SEQ ID NO: 6251 - protein, 220 aa, Corynebacterium glutamicum
MDYLAPEGAIFVSKPEGNLGGALSTTDRLNKGFARCRDPLEAENVYWEYRNNGVWIRINTDNNFQVTTADGLTSLTVTDTAVDQSGARLCAVATNASGPTMSREAVLTVRSATEIPDDGLSIDDVVLRWGISEEVQSRPLFGDSNYLSAGVSDGSALTYESTDRDVRIIHRVLLQSWARVEKPNLKTLVVLAPGCLSCLEYPADDHRVWVRVPVRSNIVP

SEQ ID NO: 6252 - protein, 255 aa, Corynebacterium glutamicum
MRLTILGSSGSVPAPGNPASGYLLTSPDAPAVIMDMGPGVLAAVQEIQDPADAHVIFSHLHTDHCADFASLMVWRRFHPTLAAKSRNLLFGPEDTPNRLGRLSSDEPDGVDDMSDTFAFDAWEERKPELIDNFTVTPFRVVHPIETYALRVEEHRTGASITYSGDSAYTEALIDAARNVDIFLCEATWGTSCDDKAPGMHMCGQDAGRIAAAAGVKKLIITHVPPWIDAEATVAAAAEHFDGPIELARSGMVIEF

SEQ ID NO: 6253 - protein, 284 aa, Corynebacterium glutamicum
MMATVTDFSGSMIERPVPGADAPIGIFDSGVGGLTVARTIIDQLPHESVIYIGDTANGPYGPLPIAKVREHAIRIADELVERGCKMIVIACNTASAAFLRDARERYSVPVVEVILPAVRRAVASTRNGKVGVIGTVGTINSGAYQDLFSASPSIVVNAVACPRFVDFVERGITSGRQILNIAQDYLEPLQAEGVDTLVLGCTHYPLLSGVIQLAMGDHVSLVSSAEETAKDVLRILSQQDLLADPDMHPEPSYSFESTGDPEIFAQLSRRFLGPIVSQVRQNEG

SEQ ID NO: 6254 - protein, 212 aa, Corynebacterium glutamicum
MCHNMAMADSPDQETRRFAAVRATSETIGSPTAVASAKRSPKGSLIGLILILVAIIVIAFVLLFNSLVAPNNSSSPVASPSTSESVEQTISESPESPSATEDQPPSSATETPRNRPAQPSLPAGASPANDAAATQTDAGNLNNVYTGSASTSAGFAQAVRDAFVNHYLDTNELSGRVTATSPVTGGNYTMNCEDNGEYVTCTGGNNAVVYIS

SEQ ID NO: 6255 - protein, 164 aa, Corynebacterium glutamicum
MTSENSESQDIWLTDEQQDVWLDVWTMRIGLPARLDAQLKEAAGVSHFEYFTMAQISMAPEHRVRMSELAELSDMTLSHLSRVVTRLEKAGWVKRVPDPDDGRATVAVLTDSGWEKVKATAPGHVKEVRRLVFDDLTPEELKVMGTAMKKIVNRLDMSNRLPRV

SEQ ID NO: 6256 - protein, 249 aa, Corynebacterium glutamicum
MSYNSPYNNTNFSTTGAFQPAGGPVKPWNKPDASLNQQLKNKSRVRTGLTIAIGYVVVIWAVHLASIVIALLTGFNLTNFGIHPLDTSALWGIFTSPLLHGSFSHLIGNTVPGFIFSFLIGMSGKRVFWEVTIIAGLIGGLGTWIFGGIGTNHIGASGLIYGWLGYLIVRGIFNKDIKQFLLGIVLAFIYSGLFWGLLPTQIGVSWQGHLFGALGGIGAGAFIASDDPAALKAKKQQKKLEKQQRQRGL

SEQ ID NO: 6257 - protein, 297 aa, Corynebacterium glutamicum
MAKNVSPSIGECDGRTALAKPSWATSAKRFAWAFVTGASVATTPMVVFSVSAALFSLSTPTPITSGLPNKAPVVRSTTSPTGFATTPAAMVYFPTRRELWPKPPRSRPAVAPVPAPTLPEPLCVPAKAFSTACSPSAAVGLFLGSPTNKSKITAPGTIGTIGPSGRTGKPIPRFSRAVITPSAAANPNAEPPHNTTACACCTELCGSRRSVSLVPGPPPRTSTPANAPLGAMTTEQPVSPFVTWPKRKPATSISINSSSLPARTLDCRQATARGFRGLPRRLPRRVHHRRQRTGGCH

SEQ ID NO: 6258 - protein, 320 aa, Corynebacterium glutamicum
MACLQSRVLAGSDDELMLIDVAGFLLGHVTKGDTGCSVVIAPNGAFAGVDVRGGGPGTRETDLLEPHNSVQQAHAVVLCGGSAFGLAAADGVMTALENRGIGFPVRPEGPIVPIVPGAVIFDLLVGDPKNRPTAADGEQAVENAFAGTHNGSGSVGAGTGATAGRLRGGFGQSSRRVGKYTIAAGVVANPVGEVVDLTTGALFGRPEVMGVGVDKLKSAAETLNTTIGVVATDAPVTKAQAKRLALVAHDGLARAVRPSHSPMDGDTFFAMSSGDGSGVTPVELAELSAHAADCVQDAIIDAILTASPGLGLKSFRELLP

SEQ ID NO: 6259 - protein, 179 aa, Corynebacterium glutamicum
MQQWKKKKGLMRQARYAVVFEPMEREVLGDLSAAVSEALIQRAQSVPKDPLAEMTGMTSGHKEAPTDPALARLLPDFQHEGDEEYDGDNSFLRSLHEGDITRAKLENLRVINDALGPDGNVAVTASEEEAHAWLAALNDIRLYVASGDVRGGEAAEEDRENLVQWLAYNQESLLEAMMN

SEQ ID NO: 6260 - protein, 100 aa, Corynebacterium glutamicum
MSSPSAPLATPDVELDVHTLSSENLPWLCIVWDDPVNLMSYVTYVFQTVLGFSKKRATELMMQVHTEGKAVVSSGEKDKVEGDVKKLHTAGLWATMQQAG

SEQ ID NO: 6261 - protein, 208 aa, Corynebacterium glutamicum
MYRAFDFVPLSMLVLVTKTRRKDHRMETLAAQARTLLEKWGVAPTHASFVESIAKAIPILSILLTLIVTVNGISSGNPVQPPALEQVRTDVVNKINYERNLKGLVSISPELELHTAAQTIAQRNADSDSEEKVPDPEGNLVVLQQNLPYANANADTIVDRFLNSPDHVKLLLANDYEAIGVGVAYKGDHAWIVVEFTVAPADSVESTE

SEQ ID NO: 6262 - protein, 446 aa, Corynebacterium glutamicum
MNTNPSEFSSNRSTALLTDKYELTMLQAALADGSAERPSTFEVFSRRLPNERRYGVVAGTARVLKAIRDFVFTEEQLADLDFLDDRTLEYLRNYRFTGQVDGYREGEIYFPQSPLLTVRGTFAECVILETVILSIMNADSAVASAAARMVTAADGRPIIEMGSRRTHEYSAVTASRAAYLAGFSTTSNLEAAYRYGIPASGTSAHAWTLLHINDDGTPNEAAAFKAQVESLGVDTTLLVDTYDITQGVATAIEVAGPDLGGVRIDSGDLGVLARKVRKQLDDLNAHNTKIVVSSDLDEFAIAGLRGEPVDVFGVGTSVVTGSGAPTAGLVYKIVEVAGHPVAKRSRNKESYGGGKKAVRTHRKSGTAIEEIVYPFNAEAPDTGKLDTLSLTIPLMRDGEIVPGLPTLEDSRAYLAKQLVSLPWEGLALSRDEPVLHTRFVGFPPAA

SEQ ID NO: 6263 - protein, 102 aa, Corynebacterium glutamicum
MGLRINLFGRPPQKTQITWKLPAQNRPQAPLSKQSNQTVNRCFAWLSLSTPIWLDLAQCLRLNHPQIPPQIRSMLPRKSCLLLPLKRWAVPVVLDRKQWLRL

SEQ ID NO: 6264 - protein, 580 aa, Corynebacterium glutamicum
MSTATIALQRQLVNRDLPRLVDALEPLMERRPTFAIMKGRSNYLCMNKVARQEELNQEDALIEQEDISWLGKHIVRLNEWANETETGDRDDLDPGVPDLAWKQVSVTARECIGASRCPHGEDCFAEIARGKAKEADVVVTNHALLAIDALSDVSVLPEHDVVVIDEAHELDGRITAVASAEITVNSLNLAARRASKLDSDKREERVQEIAGDLETLLQTMQPGRWNDMDEGSKGTLVALKDALWALRAQIAGAPEGEAANDPERFAERQNLSNHLMEIHDANVRILEVFAEEDPSKQYDVVWHNHDDRRGDSLNVAPLSVAGLLHEKLFAENTVVLASATLTIGGNFNAMAASWGLPKGSWDSMDAGTPFDPAKSGILYTARHLPDPGRDGLPEETLDEIYELITAAGGRTLGLFSSKRAAEQATKAMRLRLPFDVLCQGDDNTAALVKKFSDSENTCLFGTLTLWQGVDVPGRSLSLVLIDRIPFPRPDDPLLQARKEAADAEGRNGFMEVAATHAALLMAQGAGRLLRHVGDRGVVAVLDHRLSTKRYGGFLRFSMPRFWETTNPETVRAALKRLVTK

SEQ ID NO: 6265 - protein, 297 aa, Corynebacterium glutamicum
MTSPYGSQYPGDDNNNWNSQFGNPSGEQNYGQPYGAPYGQPYGQPFDQGFNAYSSPIPPEVPQPSMQEAQWRSFDLGTVFGQAWKGFTATWQAWVLSALIYFAVLLVLMFAWILPMVSVLAATSSGSDSAAIAATGGTSFFGFMLMIVLAFISFVYSLNCYRNAARVVRGEQITIQSFFKMKGLGKALGIYILINIVIFIGMILLLIPGIIAAVVLIFAVPVAFQLRDASIGDAFSASWKAVSKNVGQVILLELAIFALSFLGSAVIIGMLVTTPLTFLLYAYAFQTASGGPIMQRQ

SEQ ID NO: 6266 - protein, 241 aa, Corynebacterium glutamicum
MPKDSLLDAHLLLKARASDGPHSEDPSDPSTVQAMQIALHIPKQNPPRRTDVLEAAARSVVKLCLDERVSTDPDFRAALERWYGHLIRKVSRRARNAAWDRVQDLPGVTVEDDAAKVRAFLPSAVVDVPADIKKLQISGTELPLDEPNPINDEYPVIYIDESLKMTLGKAAAQVGHASMLLAAHQPFEWVEQWEAADFALHVREIPSEEFLRLIESPGAVPVRDGGFTEVAPNTVTVVAIP

SEQ ID NO: 6267 - protein, 339 aa, Corynebacterium glutamicum
MHGQSVVVELQETVQSSRPRSSHVVVVLGDPVDALDISRIGQTLADYDANIDTIRGISDYPVTGLELKVTVPDVSPGGGEAMRKALAALTSELNVDIAIERSGLLRRSKRLVCFDCDSTLITGEVIEMLAAHAGKEAEVAAVTERAMRGELDFEESLRERVKALAGLDASVIDEVAAAIELTPGARTTIRTLNRMGYQTAVVSGGFIQVLEGLAEELELDYVRANTLEIVDGKLTGNVTGKIVDRAAKAEFLREFAADSGLKMYQTVAVGDGANDIDMLSAAGLGVAFNAKPALKEIADTSVNHPFLDEVLHIMGISRDEIDLADQEDGTFHRVPLTNA

SEQ ID NO: 6268 - protein, 532 aa, Corynebacterium glutamicum
MSSVCLCAHAFNHVRVVQLERRALGADTRQGCEVVARRRAGGCPLQGVAVTPRIINGNELTVAPGLEDVPDEWNDRQAKQEGEHGGDLVVDGETIRIQVVSVTTWHTHVAHPVLDEEGSVETDEGQPEVDLAKTLVHHAASHLREPEVNACTRCEHHGTEEGVVEVRDQEVGVSQVEVQWWGRQHNAGQTTEEEGSHEANRPDHWGFPSDVTLPHGSNPVEELNAGRNRNQERHEGEERKQNCASNEHVVSPHSHGQCTNGQGCEDQADVTEHWLTGEHRNDLRNNAEERQRQNVNLRVSEEPEQVLPQEGAAVSWIVQVSTKLAVIQNTQCSSEQQWEDQQSKNGNNEDIPGENRHTEHGHTRCAEAEDGGEHVNCGSNGANTSCTDTDNPHVRAKAWGVNCVRQWGVHGPTEVGSTTRGQEAGQHRDTTDGGDPEAESIQTWESYVRRTDLKWQDVVSKTPNNWSSVQQQHDSSVHGEQLVELLIRQELQTRGEKLRSDKQGHQATEEEEAEGHNDVHNAQLLVVGGGHH

SEQ ID NO: 6269 - protein, 581 aa, Corynebacterium glutamicum
MAPRVDGHVAPQRPEPTGHARKGSKAWLMMTTTDHKQLGIMYIIMSFSFFFLGGLMALLIRAELFTPGLQFLSNEQFNQLFTMHGTVMLLLYGTPIVWGFANYVLPLQIGAPDVAFPRLNAFGFWITTVGGVAMLTGFLTPGGAADFGWTMYSPLSDAIHSPGLGSDMWIVGVGATGIGSVASAINMLTTILCLRAPGMTMFRMPIFTWNIFVVSVLALLIFPLLLAAALGVLYDRKLGGHLYDPANGGSLLWQHLFWFFGHPEVYVLALPFFGIVSEIIPVFSRKPMFGYVGLIFATLSIGALSMAVWAHHMFVTGAVLLPFFSFMTFLISVPTGVKFFNWVGTMWKGHITWETPMIWSVGFMATFLFGGLTGIMLASPPLDFHLADSYFLIAHFHYTLFGTVVFASCAGVYFWFPKMTGRMMDERLGKIHFWLTFVGFHGTFLIQHWVGNMGMPRRYADYLDSDGFTIYNQISTVFSFLLGLSVIPFIWNVFKSWRYGELVTVDDPWGYGNSLEWATSCPPPRHNFASLPRIRSERPAFELHYPHMIERMRAEAHTGHHDDINAPELGTAPALASDSSR

SEQ ID NO: 6270 - protein, 102 aa, Corynebacterium glutamicum
MPKKNVFQTIHEVAARFSHLWAVTFNQRCEGVHNLTDISPGSPTPTVNPCHRFHNSPRRGSIEWLRRPFQGRFLLKRDVPPRGPRGAWRSPTPICASEKPAP

SEQ ID NO: 6271 - protein, 334 aa, Corynebacterium glutamicum
MAADSDLSVHDAYLKEHVAPVKAINWNSIPDSKDLEVWDRLTGNFWLPEKVPVSNDIKSWGTLNEVEKAATMRVFTGLTLLDTIQGTVGAISLLPDADSLHEEAVLTNIAFMESVHAKSYSNIFMTLASTAEINDAFRWSEENENLQRKAKIILSYYEGDDPLKRKIASVILESFLFYSGFYLPMYWSSHSKLTNTADVIRLIIRDEAVHGYYIGYKYQKAVAKETPERQEELKEYTFDLLYDLYDNETQYSEDLYDDLGWTEDVKRFLRYNANKALNNLGYEGLFPADETKVSPNILSALSPNADENHDFFSGSGSSYVIGKAENTEDDDWDF

SEQ ID NO: 6272 - protein, 162 aa, Corynebacterium glutamicum
MTINEKIASAFNNQVTAELEASMVYLQLSYVLDDLGLTGMRDWMKAQSKEELEHAQKFAQHLLDRDYTPQIGDIAPPKLDVTSAIEAFEASLAHEQKISGLIRELAAIQDAEKDYDSRALIDWFLNEQIEEEATVGEIIDRLRIAGDSGSGILRIDGELGSR

SEQ ID NO: 6273 - protein, 250 aa, Corynebacterium glutamicum
MTPANESPMTNPLGSAPTPAKPLLDSVLDELGQDIISGKVAVGDTFKLMDIGERFGISRTVAREAMRALEQLGLVASSRRIGITVLPQEEWAVFDKSIIRWRLNDEGQREGQLQSLTELRIAIEPIAARSVALHASTAELEKIRALATEMRQLGESGQGASQRFLEADVTFHELILRYCHNEMFAALIPSISAVLVGRTELGLQPDLPAHEALDNHDKLADALLNRDADAAETASRNILNEVRSALGTLN

SEQ ID NO: 6274 - protein, 220 aa, Corynebacterium glutamicum
MTQWGNSNVVEDYLTALFRAEEWDEEPTTGKLAEVIGVTASTVSATLKKLNPEGFVNYRPYGDIELTPAGRDIAINVIRRRRIIETYLSEKLGLGAHELHGEADLLEHAVSPLVLEKMFQAVGYPTLDPHGDPIPTESGEMTINDGLMLLGLKAGASATVTRVRDGNPSVVRYLTGVGITVGTTVTVVEALSDIATLRLQIGEMFQDIPLAVANAVRVSR

SEQ ID NO: 6275 - protein, 146 aa, Corynebacterium glutamicum
MCSTTVSEAYSGSTATNASKATANAPEISLRTASAAHANTKEAATTAVPKISMVATGDADSSENLSTTAGIAATAHIASGIRGNIGGSLSFEELLEGLAHLVLGTWAGYTDLACQYVDNRVCRATPLQQQTSCQLAIVCVYGQEDV

SEQ ID NO: 6276 - protein, 92 aa, Corynebacterium glutamicum
MFPRIPLAMCAVAAIPAVVLRFSELSASPVATMLIFGTAVVAASFVLAWAAEAVRKDISGALAVALLALVAVLPEYASETVVEHTYQTSAAN

SEQ ID NO: 6277 - protein, 707 aa, Corynebacterium glutamicum
MPRGDQMDFHALNALLNLYDDNGKIQFEKDREAANQYFLQHVNQNTVFFHNLQEKIDYLVENKYYDPIVLDKYDFQFIKDLFKRAYGFKFRFQSFLGAYKYYTSYTLKTFDGRRYLERFEDRVCMVALTLADGDRALAENLVDEIMSGRFQPATPTFLNSGKAQRGEPVSCFLLRIEDNMESIGRSINSALQLSKRGGGVALLLSNLREAGAPIKKIENQSSGVIPVMKLLEDAFSYANQLGARQGAGAVYLNAHHPDILSFLDTKRENADEKIRIKTLSLGVVIPDITFELAKRNDDMYLFSPYDVERIYGKPFADVSITEHYDEMVDDDRIRKTKINARQFFQTLAEIQFESGYPYIMYEDTVNASNPIEGRITHSNLCSEILQVSTPSEFNDDLTYAEVGEDISCNLGSLNVAMAMDSPNFEKTIETAIRGLTAVSEQTSIDSVPSIRKGNEAAHAIGLGQMNLHGYFGREHMHYGSEEALDFTNAYFAAVLYQCLRASNKIATERGERFKNFENSKYATGEYFDDFDANDFAPKSDKVKELFAKSNIHTPTVEDWAALKADVMEHGLFNRNLQAVPPTGSISYINNSTSSIHPIASKIEIRKEGKIGRVYYPAPHMDNDNLEYFEDAYEIGYEKIIDTYAVATKYVDQGLSLTLFFKDTATTRDINRAQIYAWRKGIKTLYYIRLRQVALEGTEVDGCVSCML

SEQ ID NO: 6278 - protein, 105 aa, Corynebacterium glutamicum
MGAICNDNWCLQVAKCEDVLTCLFIKADINEVILKTSAVEGLLGGIALDASWLGVNGDCHFLDLPLSALAVDANASSHFFRSVFKVFASLKATQQTLYFVVNKRN

SEQ ID NO: 6279 - protein, 47 aa, Corynebacterium glutamicum
MRERSARMKVRNSLRSLKNKPGAQVVRRRGKVYVINKKEPRFKARQG

SEQ ID NO: 6280 - protein, 277 aa, Corynebacterium glutamicum
MTNTQTEIINELKVSPAIDVAKEVEFRVQFLVDYLRASHTKGFVLGISGGQDSTLAGRLTQLAVERIRAEENSTDYVFYAVRLPYAIQADEDDAQVALEFIAPDKSVTVNVKDATDATEATVAAALELPELTDFNRGNIKARQRMVAQYAIAGQLGLLVIGTDHAAENVTGFFTKFGDGAADLLPLAGLSKRQGAAILEHLGAPSSTWTKVPTADLEEDRPALPDEEALGVSYADIDNYLENKPDVSEKAQQRIEHLWKVGQHKRHLPATPQENWWR

SEQ ID NO: 6281 - protein, 31 aa, Corynebacterium glutamicum
MFVMYLILGKHGAVVSWGALNFGGAGQGFGV

SEQ ID NO: 6282 - protein, 166 aa, Corynebacterium glutamicum
MAKLVALRLLAEGELTASDFIRNNTDIVVLQGWNPRLQLQSVGVGDLIQLAHNLCGRTNHHGPGLSVLDLIGFKEHIVVEIHAEQLVALSCTNVNCALIHNEVHRENVHLIAATNHHATKRHRLQALQSFLLIEDVDWIVHSYLHSHKLKKKRISGTNQSSPQLRA

SEQ ID NO: 6283 - protein, 249 aa, Corynebacterium glutamicum
MPHFTKRPAQPQAALAEAAGLRWLAEASSAVAQVVSADAEQITTVGVETQLPTPDAAFKAGEELARIHLAGAPAFGCPPAGWAGLNYIGTQGQACLSTPTWGVFYSQQRVLPFARRARRRNHLTEHALWVVEAACDLISELPDDVPPARIHGDLWFGNLLFGTDGPVFIDPAAHGGHPETDLAMLDVFGAPYLDEIREGYLSINPLPDGWRERTPMHQLHPLAVHAASHGPSYGVELLHAAKATLKLLD

SEQ ID NO: 6284 - protein, 96 aa, Corynebacterium glutamicum
MDKGAIYIRTAEGNKLFSMNLNHDVLFEADEVKDGKAWSVVVRATAEIVRKLDEIAYADTLELKPWIPTLKYNYVRIVPNEITGREFTLGEEPERY

SEQ ID NO: 6285 - protein, 340 aa, Corynebacterium glutamicum
MTPAHIFSEGPINSVVLSQDEDGNFTTSYQDTFSDPSFLGEGDVLIEVGWSSLNYKDAMALKGDKGVVRTVPLIPGIDVVGTVIESADPRFGRGDEVVLNGAGLGENRHGGFTQRLKVPSEPLLHIPFNFSAQQVGALGTAGFTAALSVNALVDQGIKPEDGEILVTGSTGGVGSIALHLLNKLGYTTVAVTGRREAHAEYLTSLGASDIIDRAELSEKGRPLQKGRWAGVVDSVGSHTLVNAIAQTKWGGIVTACGMAQGPDLPGTVLPFILRGVHLVGINSVDAPRELRRRAWALLSEHLDTAVLDDMTTVIDVKDVAQAGEDLMAGKLHGRTAVRVH

SEQ ID NO: 6286 - protein, 457 aa, Corynebacterium glutamicum
MTESQDLAAFVEAAKLNDASPEAVEQLKIRVLDTVGVAIGALDAEPIVAIRGLLEDLGGTEQSTLIGGGKTSPERAAFFNSALSRYLDFMDAYLAKGETNHPSDNFGAVLAAAESVGASGKDLLTAFAVAYQVHTRLSDVAPVRAKGFDHTTQGAFAAGASAAKALGLPADQIANALAIAGTANVALRVTRTGNLSHWKGLAYPHVSKEGTWAALLASRGITGPEEVFEGNKGFKESVSGPFEIDWSKEDLESVKRTIIKKHNAEIHSQSALDAAQEIRAQEGFNVDNIEKIHLTTFDVAYSIIGGGEEGDKQLIRTKEEADHSLPWMLAVVLLDGQLNPEQYEPSRIVADDVQTLMKKIEITPSDEFSDRFPDHMPADLEVTLNDGSVFKASQDSYLGFHDNPLDWDNARKKFDALVTPFTGEELREEIATIIHELDSRQVSELTEALAKVSTTRS

SEQ ID NO: 6287 - protein, 278 aa, Corynebacterium glutamicum
MSNAVPHNVSFNFVPRAYRPEKPRTFGMTEIRAPYYSTFGTRHLQDVFDVAGQWVDGIKWAGGSFSLVPTEQVRAFSDIAHENNAYVSSGGWIETVLRYGDDAVDHYLKEAKEVGFDVIEISTGFIMLNTSGLQRLVEKVVKAGLKAKPELGLQIGSGGDSGEAELAAEGKKDIGDLVDRGKKALDAGASIIMIESEGITENVTEWDTGAAASIINGLGLENVMFEAADGPVFEWYVKNYGNECNLFVDHSQILQLEGLRQNIWGNKSTWGRVINPAP

SEQ ID NO: 6288 - protein, 264 aa, Corynebacterium glutamicum
MDFWNDRPLREFKKTKQIKVRQQVSNKVQNPNQGGSKNFLWAMVAIVVVAIVVVGFIVIQGQGSKAAKLGDRDYEDTSLAMEVGSDSITLTSANTSADAKSVQLFEDFSCSHCSELSLATDADMKTQIEDGNLVVEIKPLNFLDRENIDGHSTHALAAALAVADSNDATLYWNFRAFLMEDQSEIYNQWSDDDFADGVEALGADSSVVDAIRNGDNIQRAYDLATANGEELTEETGSLSSPRVLQDGKDVEGNISDWITTVLAS

SEQ ID NO: 6289 - protein, 554 aa, Corynebacterium glutamicum
MAHERAGQLAQPEDLIDVAELVTAYFTRKPDVNNPDQQVAFGTSGHRGSALDSAFNEDHILATTQAIVDYRNQQPKNWVGPLFIGRDTHALSEPAMISALEVLIANDVEVLVDADGRYTPTPAVSHAILRHNDGIILGTAGPSRPYADGIVITPSHNPPRDGGFKYNPANGGPADTDATDWIANRANDILRGDLADVKRVPVSGVLDERTTAYDFKGIYIADLPNVVNIDAIREAGVRIGADPMGGASVDYWGAIAETHGLNLTVVNPHVDSTFRFMTLDTDGKIRMDCSSPHAMASLIDNRDKFDVATGNDADADRHGIVTPDAGLMNPNHYLAVAIEYLFAHRPGWSADTAVGKTLVSSSMIDRVVAQLGRTLVEVPVGFKWFVPGLISGEIGFGGEESAGASFLRMDGTTWSTDKDGLILDLLAAEIIAVTGKTPSQRYAELAEEFGAPAYARTDAEANREQKAILKALSPEQVTATELAGEAITAKLTEAPGNGAAIGGLKVTTENAWFAARPSGTEDKYKIYAESFKGEEHLAQVQKEAQALVSEVLGQ

SEQ ID NO: 6290 - protein, 96 aa, Corynebacterium glutamicum
MQKLIQGLGVGAGAALGVCVRLALTLWLGDSAWPILTINVLGAFLMGWLRPNAFWGTGFLGGFTTFSAMMLNDVSFYFFTAVGCILAWLAGDRLAR

SEQ ID NO: 6291 - protein, 108 aa, Corynebacterium glutamicum
MIFLYAALGGFFGGFLRWSLAQLFPGKRATLAANTLACLAGGFFVSLDLPHLYTVLLIAGFCGALSTWSTLAKELGQLLNEKKWWPMLGYLSLTFTLGYSAVFLGMRL

SEQ ID NO: 6292 - protein, 264 aa, Corynebacterium glutamicum
MNRSTISPVEARQQFRAGLIQPTSGWSAGFAQANLISMPQDLAYDFLLFAQRNPKPCPILEVLNAGETFGGIFGSNATEADIRTDAPQYRIYAHGELIDSPASAVDYWRDDLVSFIIGCSFTFEHPMVQAGVPVRHLEAGRNVPMYETSLACRPAGSLSGNLVVSLRMIPASQVADAVRITSRYPAVHGAPVHIGDPSLIGIDDINNPDFGDAPLSEPSDVPVFWACGVTPQAMVMSSKPPLAITHAPGHMLITDAPDLGFQVP

SEQ ID NO: 6293 - protein, 455 aa, Corynebacterium glutamicum
MQLLHTPAAISISFDDPNLISTAGLVPTMALAEDRLTVPTDKGANPGAKITTLIAGMVAGADSIDDIDALRHGGMHRLFDWIYAPSTLGSFLRAFTFGHVRQLDAVASRFLVGLATQAPALVPVDASTSDYVFIDVDDTIIKVHGHQKQGAGFGYSGIRGLNALLATVTTPESAPVVVAQRLRKGSCGSPRGAGRLIADAVATTRRLPGMEDEKILLRADSAFYGHPSISAAIKAGADVSVTVRMTPNVKKAIAQVPDDAWQTIKYTNAIFDEDTGRWISVAEVAEIPFTAFTSRKKTDHIPGLLVVRRIPELNNKDVDQPGLFDLHRFHAVFTTADPGILDTVAADKTHRQHAIIEQVNADVKASALAHMPSGVFTANSAWLVCAVMAFNLTRTAGVIAAGAMARATTATIRRKLVAVPARIARSARRLILHLPRNWRWETQWSRLCDHGRLPP

SEQ ID NO: 6294 - protein, 540 aa, Corynebacterium glutamicum
MKLFHRAASVVAAALLGTGAIAPVVQSQPDQTVTLDHQEAYIQEFHRGGDRPPIVDGVGGYSDEEVAQIHEAIRQAYVSGEPHDELVPGEMWSDKIDLPATIDKAAADEAEIKIAQQQSGSQARALAAQCQFFWPSPYQVCGAILERYNQQGGPLSWMLLPIENQALNPDGQGYRQRFMSGFIYWHPTTGAHAVNNYSAQIWERHGWESGWMGYPIGGEVPVSGSNLIDGEINGWVQTFQGGRVYRTPMLEGFQIASINGMILNRWLAIGGPDSALGFPIADEAVASDGVGRFSVFQNGVLYWHPNHGAWEMTGFIEEVWKMRGGLDSQWGYPTSAPVLDSDAPVEIAQNFSGGVFDLATEIEDAGFSPIEDKEMSNLILEYFGYLGFDFPGSSSRELVQDHSKSDLMTLRASRCALKDSSQASFGGVTIPSHYDYWGCLDKSDRPDPDAYGRHDYCTLSPDSYGPLGKKAEFSGACARHDLCMDAVDANGTGYAPCHPAFYTWMSTVCTTNYAEDANFKKGCVNTAKAYYKAVQLKNPN

SEQ ID NO: 6295 - protein, 118 aa, Corynebacterium glutamicum
MRDYTIFVIRLLLLYLIVFIAFWIWSPITSESYLEAVVMAFAVSLITALVTSAVTYLASLKVIAFVGFLGFVSLIVGVYFWITVPDGILDVFFVLFGSGIFLSEVLISLKRYSRSSSF

SEQ ID NO: 6296 - protein, 55 aa, Corynebacterium glutamicum
MHVKPWMLDQPGIDGRVFMRGVVVTNNMNIKVLGNSLVDLDQELLKPGSTDVIQV

SEQ ID NO: 6297 - protein, 149 aa, Corynebacterium glutamicum
MILPVQEGISYFPTPLHLNHIGGSRFKKFLVKIDKTVPQDLDVHVICDNYATHKHPTINTWLVKHPRFHMHFTPTYSSWINQVERLFAEVTRELLQRSDHRSVQALEKDLRNWVKAWNEDPKPFIWTKTAEEILSSIARYLKRINGAGH

SEQ ID NO: 6298 - protein, 467 aa, Corynebacterium glutamicum; identical to SEQ ID NO: 5247

SEQ ID NO: 6299 - protein, 256 aa, Corynebacterium glutamicum
MPSPNLGWRHFLIAKVCIVNDLPNLPKLPFNWTWVLATVATTVVLAGIGLYVYYPSLPDPMPVHWNGSGEADNWTPKSVGSFLSLILIGPGIILLTLSGMQALLTMQSGVITQRGGAKSANEAHRQWETYKATSMHMGWYMFVLNALILVMILNEFRPNPLPGGFIIGLIGIIAATIVLLVLIGKTTTSLAKKYPMPDQDGKTWGIFYNDPDDNRILVDTGMGMNYTFNIAHTWGKIFAVLIFAVPVLIVLLTVLL

SEQ ID NO: 6300 - protein, 446 aa, Corynebacterium glutamicum
MTGFGAQVIAGLILGLILGLVARGMDSGAADGEASWLTGLLSGVGSAYVSLLKVMVPPLVFAAVVTSVAKLREVANAARLAVSTLVWFAITAFFSVLAGIAVALIMQPGVGSTVDASNAADPSRVGSWLGFIQSVIPSNILGLSGSYSENSGVNLSFNVLQILVISIAIGVAALKAGKSAEPFLKFTESFLKIIQIVLWWIIRLAPIGSAALIGNAVATYGWSALGSLGKFVLAIYVGLAIVMFVIYPVVLKLNGIPVLGFFKRVWPVTSLGFVTRSSMGVMPVTQRVTEQSLGVPSAYASFAIPLGATSKMDGCAAVYPAVAAIFVAQFYGIDLSIMDYVLIMIVSVLGSAATAGTTGATVMLTLTLSTLGLPLAGVGLLLAIEPIIDMGRTATNVTGQALVPAIVAKREGILDQDVWDAAEKGGAAIEMATVSEKETEPAEVRS

SEQ ID NO: 6301 - protein, 231 aa, Corynebacterium glutamicum
MSETASFMVAESMPIAVTKAMPNVSANAVVAVRRGFRLELVAARLPTLPNGAPITLPRPPTTGMESAGEKRNVPTMTNSAPMPTRMERVAVEESVIIAPAIAKMMPSARTMPPVIVRPIMERIVVVSMLRIASTGLTSPARRAGAHALTMVTTVPNTSAVTTAEGVKPTLDPIGMPRLLRTAEMIATRPIPPSTPRAEPKRPTMVASSTTERVICPGAAPRARRRANSRMR

SEQ ID NO: 6302 - protein, 847 aa, Corynebacterium glutamicum
MRRISLRNIGAHKVRLFLTVLAVVLGTSFVSGAMMFTNALSSTFDEAIASSFDGVDVVVSPNGASEVQGVPVETVESLREDSRINHLNINGSQTVVLADADSKAIQTTGGSSLSIYYSADDAVAQAPELAEGEAPTGTEEVLASKAGAEANGLGVGDQILVVDSSGRYNVTITGLTTTETDSATALNLQMSEAGYLERYTDGATVPSVMLSAADGTTPQELVDALAAELGSNFDVETGEALVEQATGMITQALSFVQYFLVAFGLIALLVGTFIIANTFSMIVAQRMREFALLRALGAAPGQITRSVVLEATIVGLFGSALGVLGGMGLVAIISAVLNNLGMPMGSSVGLTPSAVVTALVLGTVVTIVSAWAPARRAGEVKPVEAMRNMETTTMRSMMGRTITGGIVLALGIIFAIAGAMMTDSSTATRSILVGIGALFVIVGTFLFSPALSMPVVGGLGKVIGAPFGSVGSLAATNSKRNPRRTATTAFALTLGIALVTAIGMLSATMKDAVSDMMAEQYTADYILQGPTNGSITMPKESVNDVRDAEGVADVVLVSMNSASVNGQASYSQLGQSVTFVADGDLSKVISTESIDGSLDLSNPGVVTNQTFADENGWAVGDTLQLESMGQTIGDIELIGTFTGNDAIGNMIISESSLADTPAADTAVPQMMLVVGEEGFDKEQLRTNLEDAVADYIVISVKSATEFAGETVAMIDTMMNILYALLALSVIVAIIGIINTLALNVIERRQEIGMLRAVGVKRGQVRTMITLESVQIAIYGAVIGIAIGLGLGWAFVTVMSGEGLDAAVSIPWGQVGLMLVGSAVVGVIAALWPAVKASRTPPLDAITD

SEQ ID NO: 6303 - protein, 297 aa, Corynebacterium glutamicum
MWNRNSLGNILNSVHRGQDFLDGGIKQLVHDTTVRQENDTICIGRRLGIVGNDHNGLIILINCGAQDIQHFPRRVRIQVTGWLVAENDLRTRHQRTSTRHTLLLTTRELCRTVLKALSQTQTRGNLIEPRLINLAARDIGRQRNVLRRRQSRNQVERLENESQTITTQRGHLFVLQPRQIRITNECRTTSRSIQTSHAVHQRGLTRARRTHDGSELVLLKLHVDVIQRGDSGITLAIRLVQVHCARSGFTSRVIDRLGRVNVSLRRKRRVPILLRNIVRIVGRCARGRVTHELRCFP

SEQ ID NO: 6304 - protein, 236 aa, Corynebacterium glutamicum
MNLYKAYGQGDTTVTALDHVNVEFEKNKFTAIMGPSGSGKSTLMHCMAGLDAATGGSAFIGDTDLSRLKDKEMTSLRRDRLGFIFQSFNLVPTLTASENITLPTDIAGRKIDQSWFDEITSRLGLTERLKHRPAELSGGQQQRVACARALVSRPEIIFGDEPTGNLDSNSSREVLDILRTAVDQDDQTVVIVTHDAKAASYADRVIFLADGRIVNQLFDPTIEEILATMNGIEDIA

SEQ ID NO: 6305 - protein, 91 aa, Corynebacterium glutamicum; identical to SEQ ID NO: 3587

SEQ ID NO: 6306 - protein, 47 aa, Corynebacterium glutamicum; identical to SEQ ID NO: 3586

SEQ ID NO: 6307 - protein, 226 aa, Corynebacterium glutamicum
MDAAGISLSAVGSDFGKINITDPFEDHLERARHGVEVAKLFGAKYIRMFSFFIAEGDNPESFRKEVLSRTHAMVELAEAGGITLLHENEKGIYGDSPQRVKDLITSIDSPNYRAIYDAANYVQTGFKPFDEAWPIVKDYVDYVHIKDATIPDAEHPIGIIKPAGQGDGQYPELLAALNADGYNGFVSIEPHLGDFDEFGGLCGPDLWTSACDALAGILNNINAEYN

SEQ ID NO: 6308 - protein, 224 aa, Corynebacterium glutamicum
MASDLGIKFVAVVDKDLETAEKFATGLGAAGDSSESSVKAHGSLPALFSKKKIDVLHITTPHDQHIGLALEALHHGVNVILEKPLANELDQAQRLIDYLDENPDGPKIAVCYQNRYNVSSQELRRLLDSGDLGAINGAYSSVVWTRTPGYYTQKPWRGQQAHSGGGLLMNQAIHTLDLLQWFLGKATEVKGTVSTDKYADVIDVEDTAHAYIGHESGVHTSEVS

SEQ ID NO: 6309 - protein, 175 aa, Corynebacterium glutamicum
MPIWNHNTAYRPWLVSKLKGSRSLLDVGSGDHSFADLAGRQVAHVDVVDPLINTTFEEFQPTQSYDAITFIASLHHMNAEEGLNKAVRILNPGGKLLIVGLAKNKTASDWIISGLQAFLSRPISLINREQQIYPFPTKEPSESLHEIRQLTKQLLPHRRIRRGIHFRYLLEWTKP

SEQ ID NO: 6310 - protein, 91 aa, Corynebacterium glutamicum; identical to SEQ ID NO: 3587

SEQ ID NO: 6311 - protein, 47 aa, Corynebacterium glutamicum; identical to SEQ ID NO: 3586

SEQ ID NO: 6312 - protein, 65 aa, Corynebacterium glutamicum
MRMLFENSIVCHLLFLSLPQITLGDVWWVMPGGGSPILSITVNNNLIVGMILWVCLFPVKGLGPR

SEQ ID NO: 6313 - protein, 418 aa, Corynebacterium glutamicum
MKDKFLVTGGAQLQGAVKVYGAKNSVLKLMAAALLAEGTTTLTNCPEILDVPLMRDVLVGLGCDVTIDGSTVTITTPAELSSNADFPAVTQFRASVCVLGPLTARCGRAVVSLPGGDAIGSRPLDMHQSGLEKLGATTRISHGAVVAEAEKLVGANITLDFPSVGATENILTASVMAEGRTVLDNAAREPEIVDLCRMLRSMGANIEGEGSPTITIEGVEKLTPTQHEVIGDRIVAGTWAYAAAMTRGDITVGGIAPRYLHLPLEKLKIAGAKVETYENGFRVQMDKQPEATDYQTLPFPGFPTDLQPMAIGINAVSNGTSVITENVFESRFRFVDEMLRLGADANVDGHHVVIRGIEQLSSTSVWSSDIRAGAGLVLAALCADGVTEVHDVFHIDRGYPNFVENLQKLGATIERVSS

SEQ ID NO: 6314 - protein, 190 aa, Corynebacterium glutamicum
MAVHLTKIYTRTGDDGTTGLSNFERVPKDDPRLIAYADSDEANCAIGQVLALSSPTEDMATLLRTIQNELFDVGADLATPIEENPKYPPLRVLPEYIERLEKECDKWNEDVPALDSFILPGGTPAAALLHTARVITRRAERAAWIAVREFPSTTSTLPAQYLNRLSDLLFILSRVANNGNDVKWVPGGKR

SEQ ID NO: 6315 - protein, 281 aa, Corynebacterium glutamicum
MDTQRIKDDEDAIRSALTSLKTATGIPVTMFATVLQDNRLQITQWVGLRTPALQNLVIEPGVGVGGRVVATRRPVGVSDYTRANVISHEKDSAIQDEGLHSIVAVPVIVHREIRGVLYVGVHSAVRLGDTVIEEVTMTARTLEQNLAINSALRRNGVPDGRGSLKANRVMNGAEWEQVRSTHSKLRMLANRVTDEDLRRDLEELCDQMVTPVRIKQTTKLSARELDVLACVALGHTNVEAAEEMGIGAETVKSYLRSVMRKLGAHTRYEAVNAARRIGALP

SEQ ID NO: 6316 - protein, 136 aa, Corynebacterium glutamicum
MGSGVEKHLLKKSVVGKISKVWQFRPIISLFPQGKRCSMTLISANLSLANTANGGSGCVEGWLTGQGFEFFSKTGVNWGLTTSSGVVGVAGVALEGWGTYLNTPEKQGKWTPVPTYWRSASTMFTPKGEVHCTLVE

SEQ ID NO: 6317 - protein, 308 aa, Corynebacterium glutamicum
MYNNITETIGHTPLVKLNKLTEGLDATVLVKLESFNPANSVKDRIGLAIVEDAEKSGALKPGGTIVEATSGNTGIALAMVGAARGYNVVLTMPETMSNERRVLLRAYGAEIVLTPGAAGMQGAKDKADEIVAERENAVLARQFENEANPRVHRDTTAKEILEDTDGNVDIFVASFGTGGTVTGVGQVLKENNADVQVYTVEPEASPLLTAGKAGPHKIQGIGANFIPEVLDRKVLDDVLTVSNEDAIAFSRKLATEEGILGGISTGANIKAALDLAAKPENAGKTIVTVVTDFGERYVSTVLYEDIRD

SEQ ID NO: 6318 - protein, 182 aa, Corynebacterium glutamicum
MIREDLANAREHDPAARGDLENAVVYSGLHAIWAHRVANSWWKSGFRGPARVLAQFTRFLTGIEIHPGATIGRRFFIDHGMGIVIGETAEIGEGVMLYHGVTLGGQVLTQTKRHPTLCDNVTVGAGAKILGPITIGEGSAIGANAVVTKDVPAEHIAVGIPAVARPRGKTEKIKLVDPDYYI

SEQ ID NO: 6319 - protein, 96 aa, Corynebacterium glutamicum
MSENKNIEIVHNEGQKRFVISVDGTPAGFASYLDGPDIRNFNHTVIKPEFRGQGLSAPLIKFALDDARESGIRIHDACSAVAGFIQKNPEYKDLKN

SEQ ID NO: 6320 - protein, 294 aa, Corynebacterium glutamicum
MSIFLNSDSRIIIQGITGSEGSEHARRILASGAKLVGGTNPRKAGQTILINDTELPVFGTVKEAMEETGADVTVIFVPPAFAKAAIIEAIDAHIPLCVIITEGIPVRDASEAWAYAKKVGHTRIIGPNCPGIITPGESLAGITPANIAGSGPIGLISKSGTLTYQMMYELSDIGISTAIGIGGDPIIGTTHIDALEAFEADPETKAIVMIGEIGGDAEERAADFISKHVTKPVVGYVAGFTAPEGKTMGHAGAIVTGSEGTARAKKHALEAVGVRVGTTPSETAKLMREVVAAL

SEQ ID NO: 6321 - protein, 75 aa, Corynebacterium glutamicum
MPPNTFTNTLRTWLSPRITSRPAAIDSADAPPPMSRKFAGRCPPWRSPAAATISNVDITKPAPLPMMPTEPSSFT

SEQ ID NO: 6322 - protein, 398 aa, Corynebacterium glutamicum
MDLFEYQARDLFETHGVPVLKGIVASTPEAARKAAEEIGGLTVVKAQVKVGGRGKAGGVRVAPTSAQAFDAADAILGMDIKGHTVNQVMVAQGADIAEEYYFSILLDRANRSYLAMCSVEGGMEIEILAKEKPEALAKVEVDPLTGIDEDKAREIVTAAGFETEVAEKVIPVLIKIWQVYYEEEATLVEVNPLVLTDDGDVIALDGKITLDDNADFRHDNRGALAESAGGLDILELKAKKNDLNYVKLDGSVGIIGNGAGLVMSTLDIVAAAGERHGGQRPANFLDIGGGASAESMAAGLDVILGDSQVRSVFVNVFGGITACDVVAKGIVGALDVLGDQATKPLVVRLDGNNVVEGRRILAEYNHPLVTVVEGMDAAADHAAHLANLAQHGQFATAN

SEQ ID NO: 6323 - protein, 120 aa, Corynebacterium glutamicum
MAQLVSAPPCHGGGRGFKSRQGRSNVITEVVLFLQEIVQPLFFIFWCVFGVSGFGFLKSGGFLSSTSCLRLHGSDFLCSTSRGRFQSDFPGFPSEVAFEKSVLRSRTLGAVRLSLTDVMF

SEQ ID NO: 6324 - protein, 245 aa, Corynebacterium glutamicum
MSIEFSAPAKMKIEVWSDIMCPFCYIGKKRLDDALSTFDQAGRIEVEYKSFELMPGLETHPLRSDVEYLADAKGMSLEQARQMNGQVQAMAQATGLEMNPDETIAANTINAHRLTHFAKAHGKQQEVAQELFKAHFVDGKNVDDLDVLVSIAAEVGLDASAAREALESDVYTNEVQQDVHEARQLGVQGVPFFVFDRKYAINGAQQEEVFTGTVEKAFEEWAAENPVSPFEVIDGQSCSVDGTCN

SEQ ID NO: 6325 - protein, 273 aa, Corynebacterium glutamicum
MTNPYEAFIPLKHRTGIEPEHTFWEWENKRVHIARRRREAPVRVIVVHGLGTHSGALWPLVAAIEGADLAAIDLPKTPLYDDWLRLLESFISSEDDGRPLILIGAGTGGLLCAEAAHRTGLVAHVIATCLLNPSDQPTRRALFRFSPLTRLIQGRLRNREIPVTRVLNFSKISRSPALSKLCAADEFSGASKITWGFLASYVQHKAKLGAVPVTLMHPDHDLLTPVELSLRTLSRLKAPTDVVMLKDCGHFPIEEPGFTTMLETVTSVIARNS

SEQ ID NO: 6326 - protein, 513 aa, Corynebacterium glutamicum
MKKSDYLRRYSMSDRIASEKLRSKLMSADEAAQFVNHGDKVGFSGFTGAGYPKALPTAIANRAKEAHGAGNDYAIDLFTGASTAPDCDGVLAEADAIRWRMPYASDPIMRNKINSGSMGYSDIHLSHSGQQVEEGFFGQLNVAVIEITRITEEGYIIPSSSVGNNVEWLNAAEKVILEVNSWQSEDLEGMHDIWSVPALPNRIAVPINKPGDRIGKTYIEFDTDKVVAVVETNTADRNAPFKPVDDISKKIAGNFLDFLESEVAAGRLSYDGYIMQSGVGNVPNAVMAGLLESKFENIQAYTEVIQDGMVDLIDAGKMTVASATSFSLSPEYAEKMNNEAKRYRESIILRPQQISNHPEVIRRVGLIATNGLIEADIYGNVNSTNVSGSRVMNGIGGSGDFTRNGYISSFITPSEAKGGAISAIVPFASHIDHTEHDVMVVISEYGYADLRGLAPRERVAKMIGLAHPDYRPLLEEYYARATSGDNKYMQTPHDLATAFDFHINLAKNGSMKA

SEQ ID NO: 6327 - protein, 381 aa, Corynebacterium glutamicum
MTLKIGPFDLASPVVLAPMAGVTNVAFRTLCREQEMQRTGTISGLYVCEMVTARALVERNEKTMHMTTFAPDENPRSLQLYTVDPKYTYEAAKMIVDENLADHIDMNFGCPVPKVTRRGGGSAIPYKRRLFENIVSAAVKATEGTDIPVTVKFRVGIDDEHHTHLDAGRIAVDAGAKSVALHARTAAQRYSGEADWNEIARLKEHLADTGIPVLGNGDIFAASDATRMMEQTGCDGVVVGRGCLGRPWLFAELSAAVRGEEIPEEPTFGEVTQIILRHAELLMQHDGETKGLRDLRKHMGWYLRGFPVGGEFRSNLAKVSTYVELEDLLAPWADSTAKAEDAEGARGRQGAPAKVALPDGWLDDPEDATVPKGAEMENSGG

SEQ ID NO: 6328 - protein, 269 aa, Corynebacterium glutamicum
MLHEEFCVAQDDLGNFAEGRLLWDFFSTNSSRQLSKEPRPAQATTPNHDAIAASLLHHARCIGCRENIAIAQNWDAGICQMLLQARDLVPISLTGIALRRSAGVKRYGLRAGVDSNASSIQVSMVLIINTNAELHRHRNVRAFRSLHSRGNDVFKQTALVRNRRTATPARDLWNRAAKVHINMIRQVFINDHLRRFVGVLRVNRVQLQASGIFIRREGGHVHGFLIALNKSTRSHHFTDVQPRDCSRALHFLFTAQRAESNVGYTSHGG

SEQ ID NO: 6329 - protein, 244 aa, Corynebacterium glutamicum
MRTAYRQQLDEFAHNLIILCDLTKECMDKATDALLRTSLASAESALGNAEKLEELRTGCESQAVELLALETPVARDLRQVVSSIYIVEEITRMGALAMHVANSVRRRYPDPVIPEDMRGYFKEMARLAADMTDHIRQILIDPEPDLALEMAKSDDAVDDLHQHIMRILTLRPWPHDTKSAVDLTLLSRFYERYADHTVNVAARIIYLSTGLHPEEYMEKREQQRADADMEKRWAELERQFRTSE

SEQ ID NO: 6330 - protein, 299 aa, Corynebacterium glutamicum
MGRSPHPGAHHRCPEHWRTNHLRQVLCQAIIISENTTGVSKAMSKLKLNDVNIYYGDFHAVQNVNLEVPARSVTAFIGPSGCGKSTVLRSINRMHEVTPGAYVKGEILLDGENIYGSKIDPVAVRNTIGMVFQKANPFPTMSIEDNVVAGLKLSGEKNKKKLKEVAEKSLRGANLWEEVKDRLDKPGGGLSGGQQQRLCIARAIAVEPEILLMDEPCSALDPISTLAVEDLIHELKEEFTIVIVTHNMQQAARVSDQTAFYSLEATGRPGRLVEIGPTKKIFENPDQKETEDYISGRFG

SEQ ID NO: 6331 - protein, 307 aa, Corynebacterium glutamicum
MTNNVVTPRMDEPLKKSSAFTDISSSRKTTNTAATVIIYGAMLIAAVPLVWVLWTVISRGIAPILTADWWSTSQAGVMLMLPGGGAAHAMIGTFMQAVVTSVISIPIGIFTAIYLVEYSNGNRLGRLTTFMVDILTGVPSIVAALFVYSLWIVLFGFDRSGFAVSLSLVILMVPVIIRNTEEMLRVVPQDLREASYALGVPKWKTIAKIVLPTALSGIVTGVMLAVARVMGESAPVLVLVGSSQAINWNPFGGPQASLPLMMLDMYKAGTAPATLDKLWGAALTLVLIIAVLNIGARIISAKFSVKQ

SEQ ID NO: 6332 - protein, 338 aa, Corynebacterium glutamicum
MQAHPVAVNANSSQTKPSKKIVAEGGGSVKRPGDRIFEVLSTASAAIITAIIIAIAAFLIWRAVPALMRNAEGIGGFFTYSGAWNTTDIDAMYFGIPNLLAATLLISVIALIIAMPIALGIAIFLSNYSPKRLVKPLGYMVDMLAAVPSIVYGLWGWQVLGPALSGFYTWIESWGGSFFLFATYQNSPSFATGRNMLTGGIVLAVMILPVIAATAREVFIQTPKGHIESALALGATRWEVVRLTVLPFGMSGYVSGAMLGLGRALGETMALYMVVSPSSAFRFSLFDGGTTFATAIANAAPEFNDNTRAGAYISAGLVLFALTFIVNAGARAMVNRGK

SEQ ID NO: 6333 - protein, 375 aa, Corynebacterium glutamicum
MNLTLKRSIALVGAVTAGSFALVACSDSNESDSTSSSAASTGSSDAASIEGLSGVTGQLVAEGASSQQSAMDYFGIRYSEAVSGASLAYTPSGSGSGRTNFAAGQVAFGGSDSAMKDDQAAEAEARCNGNEAWHLPFVIGPVAVAYNLPGVDTLNLDTNIIAQIFKGEITKWNDEAIASQNEGTDLPDQDISVLYRSEESGTSDNFQKFLGASTDIWETEGQQFPTEVGSGAQGSNGVASEASNIEGAITYVEAGFANQSGLGVANIDFGSGPVELNAESVGVALGALDFLTEGHNMVVDTDAMFAMNEAGAYPLILTTYEIVCSAGYDETTRDQVKDFLTVALDSQDDQLEALGYIPVTGEHYDRLVAAVEAIQ

SEQ ID NO: 6334 - protein, 292 aa, Corynebacterium glutamicum
MNTSDRIKSTQIALDRDLREQALLLLKEVRAVDGVDALSEQFVRGLAEPGLGHSHLIVTLNDKLVGLAATDEETTELAVHPAHRRQGIGKALIDATPTSSIWAHGNTAGAQALASTLRMKKTRELLVMEISDRALDDSAAYKDPDGITHSSLANAPVEKSVAEAKWLQSNNEAFDWHPEQGGWTTHRLAQAQKADWYKDSDVLFLWDGEEIVGFHWVKQHSPELQEIYVVGLSSAYRGRGLGDPLVRLGLHHMRAHGARKVILYVEAGNTPAVAAYEKLGFTVAESHVVYEK

SEQ ID NO: 6335 - protein, 261 aa, Corynebacterium glutamicum
MEKSRKRLVTIAASTIGAVAVAGGAFWIVDASIAAHAERNLSKAVAESADLENDPRVFLGSSIYSTAFFTGKLDSVSIDMLDVEIPGVGMVNARTEVESVEVSRDQILSGDLDGTTAETFTRTLRMDGVAIGAQLGITDLDISHPIDISPSGGITSEALLTGTPPDMEDPVSVLVTLRLVGSEFQMLPYELIDAPSGLTLDDVAPDFTWKIDTLQLPLADRAMAVYLSGGSVHFQSEARNVQLTTRELSPLAAPEENSDES

SEQ ID NO: 6336 - protein, 365 aa, Corynebacterium glutamicum
MALLLDNVHVLLIANPESTTQTQKLFRRVVPALMALDGVSLEARFTHYGGHAEEMVAGLTVDDFDVIIPAGGDGTVNEVINGLLGSAEGDFRNLEDLPAIAVLPTGSANVFARALGYPTDPYAAADALVELIRKNHTRTITLGTWKGDDQGTRWFAVNAGFGIDADVIARVERARSFGFAASPLLYLQVSLRAWVKTQIKPPKITVEAVDSKGHKLQKEEVPMLLASNTNPWTFLGPLPVVTNPQNSFDTGLGLFGLTSVRGFGGVAAMMHLIGVGHGRKLEKLIAKRTIAFDDAEKVTLTCDSDQRFQVDGEYEGKPTKVVLESITDAVRVYAPKTHPTPPIMNWAVHLFKHVRDFLRVRTFGI

SEQ ID NO: 6337 - protein, 229 aa, Corynebacterium glutamicum
MSENSTPNNPVVPGAGADGPSLSDSASISGSDAVNLAAEQSKSTAHRNIPGLGDLPIPDDTANLREGPNLHDGLLALLPLVGVWRGEGQADTAEDGQYAFGQQITFAHDGENYLSFESRMWKLDEEGNPTGVDQRESGFWRINLKDEIEFVCTHAGGVVEIYYGQPLNERAWQLESASTMVTATGPSTLGPGKRLYGLLPTNELGWVDERLVGDALKPRMSAQLTRVIG

SEQ ID NO: 6338 - protein, 314 aa, Corynebacterium glutamicum
MALEPQIKSAPTPVILIVEPYGGSIRQQNPNLPMVFWDDAALTRGDGIFETLLIRDGHACNVRRHGERFKASAALLGLPEPILEDWEKATQMGIESWYSHPNAGEASCTWTLSRGRSSTGLASGWLTITPVSSDKLAQREHGVSVMTSSRGYSIDTGLPGIGKATRGELSKVERTPAPWLTVGAKTLAYAANMAALRYAKSNGFDDVIFTDGDRVLEGATSTVVSFKGDKIRTPSPGGDILPGTTQAALFAHATEKGWRCKEKDLSIDDLFGADSVWLVSSVRGPVRVTRLDGHKLRKPDNEKEIKALITKALG

SEQ ID NO: 6339 - protein, 367 aa, Corynebacterium glutamicum
MANEQIEVANNTDQIPAGYKSPLLSRSGAAEAQGAAAQAGTEGVAWHYGSPLVEQRIFETGTGLVDRSNRKVIKVEGPDAPTFLNNILSQKVDSVENGFTAGALDLDAQGRIQHTMQVTVVDGVFYLDTSAAEFDTLIGFLTKMIFWSEVTVQEADLAIITLLGQEIALPDAVFARRVDWNGPSRIDVAIRRENLEEGVDKLLEAGAKLTGLMAYTAERVKALEPAAGVDLDDKTIPHEIPHWIGRGEHLGAVHLTKGCYRGQETVARVDNLGRSPRVLVLLHLDGSAPLDPVTGAEIKAGARTVGRLGTVVHDADYGPIALGLVKRSALDKELHIDDVSVNVDRDLLPAEESEQRGRAAINKLKGL

SEQ ID NO: 6340 - protein, 71 aa, Corynebacterium glutamicum
MGRGRAKAKQTKVARQLKYSSPDMDLDSLQRELANQSPRRSYSDTPDDEDQYAEYADWDEDDTDNRAYGTN

SEQ ID NO: 6341 - protein, 358 aa, Corynebacterium glutamicum
MSDHQDTTAEGVSYAAAGVDIEAGDRAVELFAPMAKRATRPEVLGNLGGFAGLFELGKYKKPILAAGSDGVGTKLVIAQMMDKHDTIGIDLVAMCVDDLVVTGAEPLFLQDYIAIGKVVPEHVAEIVSGIAEGCVQAGCALLGGETAEHPGVMEPDHYDVSATAVGVVEADELLGPDRVRAGDVLIGMASSGLHSNGYSLARHVLLEKAGLALDGHIEELGRTLGEELLEPTRIYAKDCLALIAECEVHTFCHVTGGGLAGNLERVVPEGLVAEMSRATWTPGQIFRTISSVGKVSREEMEKTFNMGVGMVAVVAEKDRDRALAMLTARHIDCWEIGTVRNGEEGEPRVILNGEHPGY

SEQ ID NO: 6342 - protein, 494 aa, Corynebacterium glutamicum
MTQVNHPYDDLNEQAPQEECGVFGVWAPGEEVSKLTYFGLFALQHRGQEAAGIAVGDGEQILVFKDLGLVSQVFDEPILESLRGNIAIGHTRYTTAGGNTWENAQPMFRMAPDGTDIALGHNGNLINYIELLDKATELGLVDPAKKPSDTDVLTGLLASGVHDGNNLFDSAKELLPSVKGAYCLTFTDGHTLYAARDPFGIRPLSIGRLERGWVVASETAALDIVGASHVREVEPGELIAIDESGLKSARFAETTRKGCVFEYVYLARPDSVIKGRNVNEARLEIGRKLAAEAPAVGDLVIPTPESGTPAAVGFAQASGIPFGQGMVKNAYVGRTFIQPSDTLRQLGIRLKLNPLREVIAGKRLVVVDDSIVRGNTQRAVIRMLREAGAAEVHVRIASPPVKWPCFYGIDFATPGELIANAVTSDNEAEMVEAVRSAIGADTLGYVSIDSMVAATEQPANELCIACFDGKYPMGLPQGNSNADLVRKMQATASS

SEQ ID NO: 6343 - protein, 125 aa, Corynebacterium glutamicum
MRIDPLETRQAVLAVKDWIEGEGDVEKPGRAALAAATRLSVRLLAQDAPGNSVEVRVPPFVAVQCIEGPKHTRGTPPNVVETDAKTWLRLATGQTTFDAEFESGKISASGTRAKEIADWLPVVKL

SEQ ID NO: 6344 - protein, 339 aa, Corynebacterium glutamicum
MSDNPHENPRENPHRSPEVVLRFMAAPTDVLMAGSHGVGGGRVLEWIDKAAYACATQWSGTYCVTAYVGHIHFTRPIPSGHMVEVRSRIAMTGRSSMHIVNEVLSADPRDGNYTRACDCLVIFVAKDTATGRATPVPSFTPKNEEEQRVLEAANSRIGLRKAIEAEMEKQTYNGPSEAPRLITRFLAKPTDINWGGKVHGGTAMEWIDEAGAACTMEWSGNHTVAVYAGGIRFYQPIQIGDLIEVDARMMRTDKRSMQMSIHVRAGDAHRGRAELETAIHATVTYLGIDVDGEPLPAPQFVPRTPEDIQLAEHANILRDLRADYTPMPLFQRRVPLQID

SEQ ID NO: 6345 - protein, 247 aa, Corynebacterium glutamicum
MDADPLIEDDVSGAEVKDSSDEPLLALTRYVFDRGERPVTRGLFHQVAAILSIVSGSVLSTYAWMELVWWQALGVMVYALAMLGLFAVSAAYHRGPWRRLHTVAWWRKADHSTIAVFIAATYTPLCLIVLEPGTAAWMLGIAWVGAIASVIMNMVWINHPRWLSVLVYLALGWLIVPLVPQLWSGAGPTVVWLLLAGGIVYSVGALVYGFKWPGRNARVIGYHEHFHIATIVAAIVHLVAVWMVVVN

SEQ ID NO: 6346 - protein, 62 aa, Corynebacterium glutamicum
MSRTMPPTPVAAPWCGSTKDGWLWDSTRKVTALPSPMSTTPAFSPMPARILEAISSVVVSPK

SEQ ID NO: 6347 - protein, 762 aa, Corynebacterium glutamicum
MSTFVNDTVEDAIKTPELDQPFEALGLKDDEYARIKEILGRRPTDAELTVYSVMWSEHCSYKSSKVHLRYFGETTTEEMASKILAGIGENAGVVDIGDGNAVTFRVESHNHPSFVEPHQGAATGVGGIVRDIMAMGARPIAVMDQLRFGALDNPDTQRVLPGVVDGISHYGNCLGLPNIGGETVFDDSYAGNPLVNALCVGTLKVEDLKLAFASGTGNKVILFGSRTGLDGIGGVSVLGSASFEEGEERKLPAVQVGDPFAEKVLIECCLELYKAGVVVGIQDLGGGGLACATSELAAAGDGGMRVNLDNVPLRAENMSAAEILASESQERMCAVVTPENVERFLEICAKWDVTCAEIGEVTDEKDRYVVVHNGEVVIDAPPSTIDEGPVYNRPVARPENQDELQLEGEIARPVDVEEIKAAWLKLVASPALASRAFITEQYDRYVRGNTVQAKNANAGVLRIDEETNRGVAISADASGRYTKLEPNTGAQLALAEAYRNVVSTGARPVAVTNCLNFGSPENAGVMWQFKEAVHGLADGSKLLGIPVSGGNVSFYNQTGDEPILPTPVVGVLGVLDNVEQSIGNVLPSEDNDLYLLGETFDEFGGSIWQQVSGAGLNGLPPVVDLLNEQRLADLFVGSDLFAASHDLSEGGLGQTLAELAIHADKGMDVDLSQIHPSLFTSLFAESASRIVVATNRGEELEKRAAELGVPVFKLGCTNDSAVIAVKGADVEFTVSVEELREAWTNTLPEAFGHAVGANAVVA

SEQ ID NO: 6348 - protein, 240 aa, Corynebacterium glutamicum
MFRVRHETDDATSFISDTGDIVDGTVEVIGVTEHHAAFTLKLGDGLCVCLEATFTVLCRNKDLLTLFQSVGPCSGVVLYNEVCVYTVKVQTLVAGQRAWKQACFGEDLEAVANAQDWHTLTGLLNHGLHYWRQCRDCTGAQVIAVGESTGNDNCVDALEILVSVPQADYFCTCDASSACCIYIVKGAWEGNDTDFGAHFATSTPTTSKSSMTVFARRVSAIFFRSASVTESSTSSSKRFP

SEQ ID NO: 6349 - protein, 223 aa, Corynebacterium glutamicum
MSAKIGVITFPGTLDDVDAARAARIAGAEVISLWHADEDLKGVDAVVVPGGFSYGDYLRTGAISALAPVMQSVIEQAGKGMPVLGICNGFQILTEARLLPGALTRNKGLHFHCVDAHLVVENNTTAWTNTLEKGQQILIPAKHGEGRFQADAETIAQLEGEGRVVFRYTDNFNGSVNDIAGITNETGRIVGLMPHPEHAVEKLTGPSIDGLELFLSAVGTIAA

SEQ ID NO: 6350 - protein, 81 aa, Corynebacterium glutamicum
MARVVVNVMPKAEILDPQGQAVHRALGRIGVSGVSDVRQGKRFELEVDDSVTEADLKKIAETLLANTVIEDFDVVGVEVAK

SEQ ID NO: 6351 - protein, 174 aa, Corynebacterium glutamicum
MPLVKPSQPLDREILLDCFHYLSCRWFRPRSKALNRITFCIYQEFLKIPLDFATISCLFEHLVQGVGTLPIHLGFAQEREGDVVLILRESTHLSVGSRFLAVELIAGHANDKEASILVFLIQFLKPFILWRESALGCHVHDEQKVARPIRHGGFCAVVESYADVMNRSHNRNPS

SEQ ID NO: 6352 - protein, 159 aa, Corynebacterium glutamicum
MTSIHDISVTLNDGTETTMADWAGHLLLIVNVASKCGLTPQYEGLQKLYEEYQDRGFFVIGVPCNQFNGQEPGTDAEVCAFAQNQYDVTFPLLSKTEVNGEGAHPLYKVLKEATDGSEIEWNFEKFLVDAEGNTIKRFAPRTEPSAAEVVEAIEENLPI

SEQ ID NO: 6353 - protein, 916 aa, Corynebacterium glutamicum
MSRISARTLAIALAGATAASLAVVPAATANPAGTAPVINEIYGGGGNSGSLFSNDFIELYNPTSGDISLDGWSVTYYAANGNSGGTTNLTGNIPANGYYLIQQRAGSNNTGALPTPDATGNLAMGASQGSVALTDNSGLTADLVGFGGTSMFEGTAAAPETSNKLSVQRKEVGADSDNNSVDFETGAPTPTSSGGSAPVDPGEPETPVNPGETVSIAQIQGTGLATPLEGQTVTTEGIVTAVYAEGGFNGYYIQTPGSGTAPKVAGDASDGIFVYVGSNGSYPELGASVTVTGKATEHYEMTQLGNSSFTVSDTAFEPVTPLELDTVPTGDDIREAYEGMLLKPTGAHTVTNNYATNTFGEIALAPGNEPLYQATQMVAPGAEAIAYEAENVAKQITLDDGRSGNYTRGDSSTPMAWLVQDGGETIKSIRTGDQVEFQAPVIFDYRYDLWKFQPTTPVTGNTASSDLPITWDDTRAAELASINDVAGEFHIASFNVLNYFTSLGEDEPGCSAYRDINNTPVTANNCNVRGAYTEEALEDQQSKIVEAINRLDVDVLGLEEIENTATVTGDVSRRDDALNTLVAALNEAVGSDRWAAVESPEQLGTDEDYIRVAFIYDQTTVKPVGESRIFDDAAFTGTARQPLAQEFQPLNDSEKSFVGVVNHFKSKGSVTRGDADTGDGQGNNANVRVAQAQALIDHLENQDDWASKPIFILGDTNSYAKETAMTTLYGAGYTNIATEFDAGYSYQFSGRIGSLDHALGNEAAMKHVIDAEVWDINADEAIAFEYSRRLNNTSDVFENNVFRSSDHDPIKVGFNLSETTEPTIPVEPTDPAEPTDPTTPVKPTDPVETTDPSEPTDPAEPTDPAEPTDPEETKKPEEPKNPGSSNGSSQYATIAAIIAAILGAIALAFQFFPFKF

SEQ ID NO: 6354 - protein, 92 aa, Corynebacterium glutamicum
MFSECLSPWGGCLEALRSESERALFAEPGFEIRHFLKRPDRRDKIGEKVKVLARVSGFQWFKPDRRAKSSQDVRFLSRLSGLSQLGAPNLPN

SEQ ID NO: 6355 - protein, 229 aa, Corynebacterium glutamicum
MSGRLLVSVSSIFDQTRSAADRLISDLRADGIEVSLLVAPRIDGDWRLAKDKGTLAWMEQQRERGHELILNGFDQAVQGRRSEFANLERHEARLRLTGAIRQMQKIGFEFQIFAPPRWRMSEGTFAVLPEFDFNVAASTRGLHNLDTGEFLACRNLSVGEGFGAAKWWRKNVIKAVTRGAEKGNTVRLSASARNLTNPKVAADFREAALAALDLGAQVQTYSQAAAQLA

SEQ ID NO: 6356 - protein, 446 aa, Corynebacterium glutamicum
MDSNTESSSVEVKNEHIKVQKPPKKDRTHWLYIAVIIALIGGITLGLISPELGKEFKILGTMFVSLIKMIIAPVIFCTIVIGIGSVKAAATVGRAGGIALAYFITMSTFALAVGLLVGNFIQPGSGLNISVDEESSFASTESSPEGLLGFIHSIIPETFFSAFTDGSVLQVLFIAILVGFAAQSMGEKGQPILDFVSHLQKLIFKILNWILWLAPVGAFGAMAGVVGETGFDAVVQLGILILAFYVTCVIFIFGVLGAVLKVFTGVNIFKLVKYLAKEFLLIFATSSSESALPNLMRKMEHIGVAKPTVGIVVPTGYSFNLDGTAIYLTMASIFIADAMNMPMSLGEQVGLLVFMIIASKGAAGVSGAGIATLAAGLSSHRPELLHGVDVIVGIDKFMSEARALTNFAGNSVATLLVGKWTGTVDMNQVHDVLNGKSPFVELEEDH

SEQ ID NO: 6357 - protein, 706 aa, Corynebacterium glutamicum
MSERLNAPQAPIHPITRTHHGIDFVDNYEWLRDKESQETLDYLEAENAFTKQETEQLATLRDNIYEEIKSRVKETDMSIPVRAGKHWYYSRTEEGKSYGYSCRIPVTEGSDAWTPPVIPEGEPAQGETIIMDANELAEGHEFFSMGASSVTTSGRYLAYSTDVTGEERFTLRIKDLETGELLPDTLTGIFYGATWVGEEYLFYQRVDDAWRPDTVWRHKVGTPVEEDVLVYHEPDERYSTWVGTTRSEKFILFGCASKITSEVRVLPFDQPEGTPEVLIPRAEGVEYDVDHAVVDGSDIWLVTHNAEGPNFSVGWAGVDKLNSLDALAPLVAHKDDVRIEGVDTYRDFIILGYRSGAIGQVAIMKLIDGTFGDFQQLEFDEEIYTVASGGNPEWDAPVIRLSYGSFTTPAQLFNYWIESGERTLLKQQEVLGGYKPSDYVASRLWVTAKDGAQIPVSLVHRTDLDVSKPNPTLLYGYGSYESSIDPGFSIARLSLMDRGMIFAIAHVRGGGEMGRGWYDNGKTTTKKNTFTDFIDVADALIEQKISAPEMLVAEGGSAGGMLMGAIANMAGDRFKAIEANVPFVDPLTSMLMPELPLTVIEWDEWGDPLHDKDVYEYMASYAPYENIEAKNYPNILAVTSLNDTRVLYVEPAKWVAQLRATATGGEFLLKTEMVAGHGGVSGRYEKWRETAFEYGWLINQATGVTE

SEQ ID NO: 6358 - protein, 208 aa, Corynebacterium glutamicum
MIHVSQKKFWDEQWCARSSTCFLLNAWFVDTSLALDLLNTSRPAPCVELSSQKASLNLLSCLSQSLPQPPRLTSATTTSMSPLTLLKNVSAKLVRTSCAMPLLLFTRLLLRSPVTVASSLPTPNLSSASMKMAPSCLVMKSLPQIPPATGLWKAMKQDLCNQALISNSCATGSPALNLAGTRIPAWSHQLCQVPLLRQPASATSRPTS

SEQ ID NO: 6359 - protein, 297 aa, Corynebacterium glutamicum
MRPELSQYKHLSAGKVREIYEIDDKHILMVASDRISAYDFILDTEIPDKGRVLTAMSQFFFDTIDFPNHLAGPADDPRIPEEVLGRAMVCKKLNMLPFECVVRGYLTGSGLVEYKQTSSVCGVELPEGLVESSQLPEPIFTPATKADIGDHDINVSFDVVEERLGEARANQLRDASIAIYKAAAEIARDRGVILADTKFEFGIDEDGTLVLGDEVLTPDSSRYWPLEGYEAGSVQPSFDKQFVRNWLTGPKSGWDKDSGLEPPALPGSVVEATRERYIEAYELISGQKFCQWIGSCV

SEQ ID NO: 6360 - protein, 476 aa, Corynebacterium glutamicum
MADKKKIANVLSNRYASAELSNLWSAEEKIIMERQLWIAVMKAQKDLGVEIPAEAIESYEAVIDQVDLASIADRERVTRHDVKARIEEFNALAGHEHIHKGMTSRDLTENVEQLQIHRSLELVRNKGIAVVAAIGSRAAQYQSLVMAGRSHNVAAQATTLGKRFATAADEMLVALERVTELLNRYPLRGIKGPMGTAQDMLDLMEGDEARLSDLETRIAAHLGFDRVFDSVGQVYPRSLDFDAVSALVQLGSGPSSLSHTIRLMAGTETVTEGFKEGQVGSSAMPHKMNARSCERVGGLQVILRGYLTMVADLSGQQWNEGDVFCSVIRRVALPDAFFAIDGMFETFLTVLDEFGAFPAMIERELERYLPFLATTRILMAAVRAGVGRETAHEVIKENAVAVALNMRENGGDQDLIQRLAADERLPMSEADLEAALADRHAFIGAAESQVSRVLDRIQVLVDAHPGAADYRPGEIL

SEQ ID NO: 6361 - protein, 386 aa, Corynebacterium glutamicum
MSLMKPSTRSNVQPFRVMQMLDRVHRRRREGKDTLMFCAGQPSTGAPEAVIEEAEIALRSGPLGYTEVIGDREFRERIADWHSATYDVDTNPDNVIVTTGSSGGFVASFIATLDHGDYVAMPTPGYPAYRNILESLGAKVLNLRCTAETRFQPTAQMLEELPHKPKAVIVTSPGNPTGTIIDPEELERIAKWCDDNDAVLISDEDYHGMSFGRPLATAHQFSKNAIVVGTLSKYFSMTGWRVGWIIVPDELVTPIENLQASLSLCAPAIGQAAGRAAFTLEAGAELDAHVEAYREAREVFVDKLPEIGLGTFADPDGGLYLWVDVSAYTDDSEEWALRLLDEAGVAVAPGVDFDPEEGHKWIRLSLCASKEDTIEGVRKIGEFIKK

SEQ ID NO: 6362 - protein, 421 aa, Corynebacterium glutamicum
MRILVIGSGAREHALLRGLSTDPATTELHVAPGNAGLGSIATVHPGIKADDPEAVTALAKELNSDLVVIGPEIPLVAGVADALRAAGIAVFGPNKDAARIEGSKAFAKDVMAAQGVRTAHAEAITPGASSEDIDAAIDRFGPTWVVKDDGLAAGKGVVVTPDRAAARAHVDAVLEGGNPVLLESFLDGPEVSLFCLVDGETVVPLLPAQDHKRAYDNDEGPNTGGMGAYAPLPWLPEDGVQRIVDEVCVPVAREMVARGCAYSGLLYAGIAWGAEGPAVVEFNCRFGDPETQAVLALLKTPLAVLLNAVATGTLAEQPALEWEDAYALTVVLASYNYPEAPRTGDVIRNADADNVLHAGTALNAEGELVSAGGRVLNVIGVGETLEAARDNAYTTIKDIELEGSHYRSDIALAALEGRISI

SEQ ID NO: 6363 - protein, 138 aa, Corynebacterium glutamicum
MHMASVFTKIINGELPGRFVYRSENVVAFLSIEPLTYGHTLVVPVAEVDRWTDLPQNIWSEVNEASQLIGNAIRTAFDAPRCGYIIAGFDVPHTHIHLFPTDKMADYDFRNAMAADATDPAKMDEAAEKIREALDGLV

SEQ ID NO: 6364 - protein, 145 aa, Corynebacterium glutamicum
MTENVGAGSFRSPGLVFRNRPTQIAKTHPKAKQRGGLFLIKQLELQELDQTVQRFADLLCSFIHFCRVGGVCGHGVAEIVIGHFVGGEEVDVSVGNIESCDDVTTSRGVECCADCISDELGGLVYFAPDVLRKVGPAVNFCNGYD

SEQ ID NO: 6365 - protein, 251 aa, Corynebacterium glutamicum
MTSPELQNILNNYWSGRAEAYHLNQTQSERAQFERPIWEKVWSKALPIVSEEAVKVLDLGCGAGYVTHLLSDCGYETIGVDGSEEMINQATQENGLRRSTGRATAIFQVGDAHDPEFREGSFDAITSRYVLWTLLDPQAAINRWVSLLKPGGVIACVDAAWYPKGIDAGTEVDSVDGPSAFVETYTPELLRNLPMSTTSTGHNFAELFHNAGLKEVTLTPIEGLAELDQRFGLSPGHESTPQFLFRGIKSS

SEQ ID NO: 6366 - protein, 452 aa, Corynebacterium glutamicum
MQALLVYYLYFDVAAGGLGLDQTQATGLVGVYGALLYLCCWAGGWVSDRVLGAEKTLLGGAISVTIGHLVLAGLGGKIGLAIGLGCIAIGSGFVKTAAITVLGSRHGEQEGDAKADPAFQLFYLGINVGALLGPLLTGWLSSRYSFEMGFGAAAVLMIGGLGIYAALRKPMLQSFPLEVKKALLRAQNPAEKHVISTAFAAVAVLCGVLLYLLLTETVSADQLAGALLLVTIGAALWLIIQPLRHPQVSSEEKRKVLAFIPIFVCSTAFWAVQAQTYGVLAVYSQERVDRMVGDFEIPAAWSQSLNPFFILALSIPISLWFMRGSRAPRVKIGISIGVIIAGSGLLVLIPFVGMPLAPVWVLPLSVFLISLGELFIGPGGMAATAHHAPRIFATRFSALYFLTLAIGMSIAGNVSKFYDPTNHTSELRYFAVFGISIIVIGVGSLMVAKKVG

SEQ ID NO: 6367 - protein, 423 aa, Corynebacterium glutamicum
MENPSLRELDHRNIWHPYAAPGVRNRLVTKTDGVFLTLEDGSTVIDAMSSWWSAIHGHGHPRLKAAAQKQIDTMSHVMFGGLTHEPAIKLTHKLLNLTGNSFDHVFYSDSGSVSVEVAIKMALQASKGQGHPERTKLLTWRSGYHGDTFTAMSVCDPENGMHSLWKGTLPEQIFAPAPPVRGSSPQAISEYLRSMELLIDETVSAIIIEPIVQGAGGMRFHDVALIEGVATLCKKHDRFLIVDEIATGFGRTGELFATLSNGLQPDIMCVGKALTGGFMSFAATLCTDKVAQLISTPNGGGALMHGPTFMANPLACAVSHASLEIIETGMWQKQVKRIEAELIAGLSPLQHLPGVADVRVLGAIGVIEMEQNVNVEEATQAALDHGVWIRPFGRLLYVMPPYITTSEQCAQICTALHAAVKGK

SEQ ID NO: 6368 - protein, 224 aa, Corynebacterium glutamicum
MPFLFVSGTGTGVGKTFSTAVLVRYLADQGHDVLPVKLVQTGELPGEGDIFNIERLTGIAGEEFARFKDPLAPNLAARREGVEPIQFDQIISWLRGFDDPDRIIVVEGAGGLLVRLGEDFTLADVASALNAPLVIVTSTGLGSLNAAELSVEAANRRGLTVLGVLGGSIPQNPDLATMLNLEEFERVTGVPFWGALPEGLSRVEGFVEKQSFPALDAFKKPPAR

SEQ ID NO: 6369 - protein, 485 aa, Corynebacterium glutamicum
MENPYVAALDDENQEVGVKKEAEKEPEIGPIRAAGRAIPLRTRIILIVVGIAGLGLLVNAIAVSSLMREVSYTRMDQELETSMGTWAHNVELFNFDGVRQGPPSDYYVAKVFPDGSSIIFNDAQSAPDLAETTIGTGPHTVDAASGSASNTPWRVMAEKNGDIITVVGKSMGRETNLLYRLVMVQMIIGALILVAILITSLFLVRRSLRPLREVEETATRIAGGDLDRRVPQWPMTTEVGQLSNALNIMLEQLQASILTAQQKEAQMRRFVGDASHELRTPLTSVKGFTELYSSGATDDANWVMSKIGGEAQRMSVLVEDLLSLTRAEGQQMEKHRVDVLELALAVRGSMRAAWPDRTVNVSNKAESIPVVKGDPTRLHQVLTNLVANGLNHGGPDAEVSIEINTDGQNVRILVADNGVGMSEEDAQHIFERFYRADSSRSRASGGSGLGLAITKSLVEGHGGTVTVDSVQGEGTVFTITLPAVS

SEQ ID NO: 6370 - protein, 235 aa, Corynebacterium glutamicum
MDNQSDGQIRVLVVDDEPNIVELLTVSLKFQGFAVMTANDGNEALKIAREFRPDAYILDVMMPGMDGFELLTKLRGEGLDSPVLYLTAKDAVEHRIHGLTIGADDYVTKPFSLEEVITRLRVILRRGGAVEEDTSTSLQYADLTLNDETHEVTKAGELIDLSPTEFNLLRYLMLNAEVVLSKAKILDNVWHYDFGGDGNVVESYISYLRRKVDTQDPQLIQTVRGVGYVLRTPRS

SEQ ID NO: 6371 - protein, 251 aa, Corynebacterium glutamicum
MTDRTIGEAAELLGVTTRTLRHWDSIGLLQPSWRTTTDYRLYTEDDVERALQILIYRAAGIGLKDIAEVLDQPDSANQHLRRQRELLVEQIGQLHRMVRAVDEILGKDAISVKEKIEIFGEDLPKYQEEAFQRWGDTPEWKESQKIQEKMTKEDFQRAKDEHEGFVEKLIDASLRGIAPGSAEGNELALAHRASIGQWYTVSANKQVILARMYVEDERFNETYKGHASYLLTLIEALAQVEGVDLENVEWE

SEQ ID NO: 6372 - protein, 380 aa, Corynebacterium glutamicum
MGTGHGIQQGGHPNRLWWRSRSDDRSGPFEHKEYSYSMMIDTPAVLIDRERLTANISRMAAHAGAHEIALRPHVKTHKIIEIAQMQVDAGARGITCATIGEAEIFAGAGFTDIFIAYPLYLTDHAVQRLNAIPGEISIGVDSVEMAQATAGLREDIKALIEVDSGHRRSGVTATASELSQIREALGSRYAGVFTFPGHSYGPGNGEQAAADELQALNNSVQRLAGGLTSGGSSPSAQFTDAIDEMRPGVYVFNDSQQITSGACTEKQVAMTVLSTVVSRNVSDRRIILDAGSKILSTDKPAWIDGNGFVLGNPEARISALSEHHATIFWPDKVLLPVIGEQLNIVPNHACNVINLVDEVYVREADGTFRTWKVVARGRNN

SEQ ID NO: 6373 - protein, 579 aa, Corynebacterium glutamicum
MAHSYAEQLIDTLEAQGVKRIYGLVGDSLNPIVDAVRQSDIEWVHVRNEEAAAFAAGAESLITGELAVCAASCGPGNTHLIQGLYDSHRNGAKVLAIASHIPSAQIGSTFFQETHPEILFKECSGYCEMVNGGEQGERILHHAIQSTMAGKGVSVVVIPGDIAKEDAGDGTYSNSTISSGTPVVFPDPTEAAALVEAINNAKSVTLFCGAGVKNARAQVLELAEKIKSPIGHALGGKQYIQHENPFEVGMSGLLGYGACVDASNEADLLILLGTDFPYSDFLPKDNVAQVDINGAHIGRRTTVKYPVTGDVAATIENILPHVKEKTDRSFLDRMLKAHERKLSSVVETYTHNVEKHVPIHPEYVASILNELADKDAVFTVDTGMCNVWHARYIENPEGTRDFVGSFRHGTMANALPHAIGAQSVDRNRQVIAMCGDGGLGMLLGELLTVKLHQLPLKAVVFNNSSLGMVKLEMLVEGQPEFGTDHEEVNFAEIAAAAGIKSVRITDPKKVREQLAEALAYPGPVLIDIVTDPNALSIPPTITWEQVMGFSKAATRTVFGGGVGAMIDLARSNIRNIPTP

SEQ ID NO: 6374 - protein, 494 aa, Corynebacterium glutamicum
MTSETLQAQAPTKTQRWAFLAVISGGLFLIGVDNSILYTALPLLREQLAATETQALWIINAYPLLMAGLLLGTGTLGDKIGHRRMFLMGLSIFGIASLGAAFAPTAWALVAARAFLGIGAATMMPATLALIRITFEDERERNTAIGIWGSVAILGAAAGPIIGGALLEFFWWGSVFLINVPVAVIALIATLFVAPANIANPSKHWDFLSSFYALLTLAGLIITIKESVNTARHMPLLLGAVIMLIIGAVLFSSRQKKIEEPLLDLSLFRNRLFLGGVVAAGMAMFTVSGLEMTTSQRFQLSVGFTPLEAGLLMIPAALGSFPMSIIGGANLHRWGFKPLISGGFAATAVGIALCIWGATHTDGLPFFIAGLFFMGAGAGSVMSVSSTAIIGSAPVRKAGMASSIEEVSYEFGTLLSVAILGSLFPFFYSLHAPAEVADNFSAGVHHAIDGDAARASLDTAYINVLIIALVCAVAAALISSYLFRGNPKGANNAH

SEQ ID NO: 6375 - protein, 177 aa, Corynebacterium glutamicum
MRTSKKEMILRTAIDYIGEYSLETLSYDSLAEATGLSKSGLIYHFPSRHALLLGMHELLADDWDKELRDITRDPEDPLERLRAVVVTLAENVSRPELLLLIDAPSHPDFLNAWRTVNHQWIPDTDDLENDAHKRAVYLVQLAADGLFVHDYIHDDVLSKSKRQAMLETILELIPSQT

SEQ ID NO: 6376 - protein, 440 aa, Corynebacterium glutamicum
MTVQEFDRATKPTPKPPIVSWAFWDWGSASFNAVLVTFIFSVYLTDSVGATLPEGSNATSLYSMAVAIAGVIVAVVAPVMGRRSDIKGTRRRSLRMWTLVTVFLMFCLFTVKNTDPTFFWFGVAIMAIANITFEFAEVQYYAQLSQISTRENVGRVSGFGWSMGYFGGIVLLLVCYLGFVAGDGDTRGFLNLPIEDGMNIRLVAVLAAVWFLVSAIPALLRVPEIEAQVAAEDHPKGLIAAYKDLFGQIAELWKQDRNSVYFLIAAAVFRDGLAGVFTFGAILAVSVYGLSAGDVLLFGVAANVVSALGALLGGFLDDRVGPKPIILISLAIMIADAAILFFVEGPTNFWIFGLILCAFVGPAQSASRSYLTRLSPDGQEGQLFGLYATTGRAVSWMVPSLFGVFVGLTGDDRTGILAIALILLFGIVLLSMVKPPHKVK

SEQ ID NO: 6377 - protein, 714 aa, Corynebacterium glutamicum
MKKHVTSAVTAVVTAFSTAALGLSIAVSPAVAQVANPAPDLSAPYTWVEEFDSEDALKGWNIFRQPDYGSDKVLYTEDALSIEDGKLTITTQRHCVDEDFAISDPVNRGKLNDSTAQVEPCAPGQFEKFTSARIVTPKIARGEFDLSVTATLNTGGVEGVRSAIWMQNGEQACSSATNNGLYGELDLVEHFSYDLRSPWSPSNTHLGCDPESVNGTNRAPRELKLDESLDGVEHTWTVSTTRDGVEYFIDDEAINRQSWRNDVTLGHAEIDDFGISAQTFDEIVDREWTLTLNQKVESADWAKPRSSEEDFPVRSMVIDRIEVTGSPAVSEDTPMPDTTQLLTQDTLEYLGRMPVLERYEPASADFADGRRPSWNYFNLKESWQNPELEQRPEAVEFVDGRMDIVTRRHCLATTDDIATPENAQEEPCAPGEVTRYSSARVHLPEIPAGNFRLTVRARAQSEELVDGVRPAIWMQNNTNFCADNDGRPYGELDITEFYSSRVNTQYSAVHLGCAGNRPEMKLRQMEMEESMFGDWHDWGVEVFDGQIVFTIDGKAVTSSGKDVFGNSVTPAAAPLRPAHFKLSEEEYREVIGQPWHLILNTMVEQSGKDSWITAVDNNEAFPEHRFQIDHVAVDIESDSVDNVWPDAANEIPDNVGIEDSDDGSDLEVGSTGSSTAETVSWISLFTALSSLVFTLALNQEALQNLINQFMRQFK

SEQ ID NO: 6378 - protein, 320 aa, Corynebacterium glutamicum
MNKGVVLAAGGFSQNPELRKKYMPEPTPQFSRTNESATGDTMALAAKVGARLGDDNGENALWFPSSIGTRADGSTAVYPHIWDRGRLGVIAVNAAGERFVDESVSYHRFVRAMYESNKTTPTVSAWLIVDSHTLAKYGLGMITMPHLPKLALQKYIDSGYLHAGSSLDELARSIGVDARGLEQTVKRYNTFAKTGIDEDFHKGELLFGQAAGDPDNKPNPNVGPIKKGPFYAIAVVPTPLATAFGISINPNGQVVSEDGEPIIGLYSAGNDAQSVMASEYPGAGSQVGSGMTFGWIAAQHAVGKAGKSGGAKAGYAASSK

SEQ ID NO: 6379 - protein, 235 aa, Corynebacterium glutamicum
MEIRWLEGFIAVAEELHFSNAAIRLGMPQSPLSQLIRRLESELGQKLFDRSTRSVELTAAGRAFLPHARGIVASAAVAREAVNAAEGEIVGVVRIGFSGVLNYSTLPLLTSEVHKRLPNVELELVGQKLTREAVSLLRLGALDITLMGLPIEDPEIETRLISLEEFCVVLPKDHRLAGEGVVDLVDLAKDGFVTTPEFAGSVFRNSTFQLCAEAGFVPRISQQVNDPYMALLLAR

SEQ ID NO: 6380 - protein, 271 aa, Corynebacterium glutamicum
MMIQGHLFHQDRKRTFRIVEPFGSTTDALIYFHGSQQSGSVGRSFTNRTFDPLPFMVVYPDGVDQHWNDARLGLDENTRHLGIDDVGFFVKLATHLGNTYGIKRIFIVGYSNGGQMVLRLMHEVPKMLSGAATIASNMPVAENTLPQVKTFKTHPVPYLAMAGTADTFSPYEGGDAGIGREHRRGVGMSAFDSAAYIAARNGLTEHRHDVIDDVVSIDTWDGENPVEFWTLNGIGHLVPSGKTYPEFLGPSTTSVIAAEEIGKFFDGVRRR

SEQ ID NO: 6381 - protein, 271 aa, Corynebacterium glutamicum
MGKLLFVDIGGTLLDYSNEVPRSAVDAIRKARAKGHRVYLSSGRSSAEVTSQLWDIGVDGLIGANGGYVESAQESVFHRRLSGEETRHIVEWLYNRGLEFYLESNNGLYASRGFREASKPVLSRLSEKTDVTVDSMYPDMFWGASLDRDDVNKISYIFNSQEDLDAAREAFPNLEHTTWGGQTGALFGTIGVSVNKKIGVDRLLKYLNADRANTIAFGDSDEDLSLFEASAYGVAMGEATESLKAAADLVTDAVGQDGLRNAFLKLELIDA

SEQ ID NO: 6382 - protein, 153 aa, Corynebacterium glutamicum
MKLIDDRESQMAQGISAAELQALKLRAAELRAEGAGGTGTKEKEREAADCVSLIESLEGLDRQIAELLHRVVKDEAPHLDPQVRDGVPAYAREGTVIVFFQPASQHDSRYGSIGFNDEAFLDDGDFWATSFAVLAVSDKFEAKLRGLVGKAAG

SEQ ID NO: 6383 - protein, 133 aa, Corynebacterium glutamicum
MTTNQEKYPISDLVRNQRRTLDMNQEHLAKAIDKTRFWVIDLEKGISRRTGEPFTVDPMMCMKLAEALDLDPVEVLSAAKVPESEWPNFSKIISQSDYVKHVDITRLTVRQQDLVINLVNEFKELNLNTPYEK

SEQ ID NO: 6384 - protein, 501 aa, Corynebacterium glutamicum
MDSFSLQNVFQRMLSFATLRGRISTVDAAKAAPPPSPLAPIDLTDHSQVAGVMNLAARIGDILLSSGTSNSDTKVQVRAVTSAYGLYYTHVDITLNTITIFTNIGVERKMPVNVFHVVGKLDTNFSKLSEVDRLIRSIQAGATPPEVAEKILDELEQSPASYGFPVALLGWAMMGGAVAVLLGGGWQVSLIAFITAFTIIATTSFLGKKGLPTFFQNVVGGFIATLPASIAYSLALQFGLEIKPSQIIASGIVVLLAGLTLVQSLQDGITGAPVTASARFFETLLFTGGIVAGVGLGIQLSEILHVMLPAMESAAAPNYSSTFARIIAGGVTAAAFAVGCYAEWSSVIIAGLTALMGSAFYYLFVVYLGPVSAAAIAATAVGFTGGLLARRFLIPPLIVAIAGITPMLPGLAIYRGMYATLNDQTLMGFTNIAVALATASSLAAGVVLGEWIARRLRRPPRFNPYRAFTKANEFSFQEEAEQNQRRQRKRPKTNQRFGNKR

SEQ ID NO: 6385 - protein, 109 aa, Corynebacterium glutamicum
MPAKITDTRPTPESLHAVEEETAAGARRIVATYSKDFFDGVTLMCMLGVEPQGLRYTKVASEHEEAQPKKATKRTRKAPAKKAAAKKTTKKTTKKTTKKTTAKKTTKKS

SEQ ID NO: 6386 - protein, 485 aa, Corynebacterium glutamicum
MDDSNSFVVVANRLPVDMTVHPDGSYSISPSPGGLVTGLSPVLEQHRGCWVGWPGTVDVAPEPFRTDTGVLLHPVVLTASDYEGFYEGFSNATLWPLFHDLIVTPVYNTDWWHAFREVNLKFAEAVSQVAAHGATVWVQDYQLLLVPGILRQMRPDLKIGFFLHIPFPSPDLFRQLPWREEIVRGMLGADLVGFHLVQNAENFLALTQQVAGTAGSHVGQPDTLQVSGEALVREIGAHVETADGRRVSVGAFPISIDVEMFGEASKSAVLDLLKTLDEPETVFLGVDRLDYTKGILQRLLAFEELLESGALEADKAVLLQVATPSRERIDHYRVSRSQVEEAVGRINGRFGRMGRPVVHYLHRSLSKNDLQVLYTAADVMLVTPFKDGMNLVAKEFVANHRDGTGALVLSEFAGAATELTGAYLCNPFDVESIKRQMVAAVHDLKHNPESAATRMKTNSEQVYTHDVNVWANSFLDCLAQSGENS

SEQ ID NO: 6387 - protein, 171 aa, Corynebacterium glutamicum
MFGTVGRKLMNRARIATIGVLPLALLLASCGSDTVEMTDSTWLVTNIYTDPDESNSISNLVISQPSLDFGNSSLSGFTGCVPFTGRAEFFQNGEQSSVLDADYVTLSSLDFDKLPDDCQGQELKVHNELVDLLPGSFEISRTSGSEILLTSDVDELDRPAIRLVSWIAPTS

SEQ ID NO: 6388 - protein, 256 aa, Corynebacterium glutamicum
MTLTIEEIAKTKKLLVVSDFDGTIAGFSKDAYNVPINQKSLKAVKDLSQQADTDVVILSGRHLEGLKTVLDLGQYDITMVGSHGSEDSSRPRTLTPEEVARLAKIEADLEKIVDGIEGAFVEIKPFHRVLHFIRVSDKDKVQGILAQAAHVDSSGLKVTNGKSIIEYSISSTTKGTWLKEYVDRTEPTGVIFLGDDTTDEHGFKALENDDRALTVKVGEGDTAAKTRVDDVDNVGIFLEKLAYHRMQYAESVRLGI

SEQ ID NO: 6389 - protein, 358 aa, Corynebacterium glutamicum
MGRKQQYGTLASIAAKLGISRTTVSNAYNRPEQLSAELRQRILDTAEDMGYLGPDPVARSLRTRRAGAIGVLLTEDLTYAFEDMASVDFLAGVAQAAGDTQLTLIPASPASSVDHVSAQQLVNNAAVDGVVIYSVAKGDPHIDAIRARGLPAVIADQPAREEGMPFIAPNNRKAIAPAAQALIDAGHRKIGILSIRLDRANNDGEVTRERLENAQYQVQRDRVRGAMEVFIEAGIDPGTVPIMECWINNRQHNFEVAKELLETHPDLTAVLCTVDALAFGVLEYLKSVGKSAPADLSLTGFDGTHMALARDLTTVIQPNKLKGFKAGETLLKMIDKEYVEPEVELETSFHPGSTVAPI

SEQ ID NO: 6390 - protein, 314 aa, Corynebacterium glutamicum
MKKLLWTLPILPLVLAGCSTGSADSADSTNAAGSNSLKVVTSTQVWADVAEAVAPDVDIEAIITGGDIDPHSFEPSATDMAKVSEADIIIVGGGGYDSWLYGTLEDDDRIIHALDLSEHDHSEHDDHEHEAEEAHEHDHDEEGHDHDVDNEHVWYSTEYVSEVAEEFAEKVTELDPEAQADATAVTTKMDELHNQIHDLPAVRIAQTEPIADHILSHSDMVESTPEGYRATTLSESEPTAADVASFQDAINNGDLDVLIYNPQSASTVATSLKDLAEEKGIPVVEIYETPQNTENFLDAFTKAVDDLTAATNQV

SEQ ID NO: 6391 - protein, 230 aa, Corynebacterium glutamicum
MLLTFNDAAVDPLWRGLNLELRQGEFLAVLGPNGVGKSTLIGTILGTRKLTHGSVKTDARVGYIPQQRIFDVPLRARDMVSLSAAHGVVSKRGPAKGDVDKLLARVGASGIADRRVGELSGGQQQLVRQAQALATRPQLLLADEPLLSLDPGVAQRTVSLFGELKAEGVGVVVVTHDVNPLMGLVDRILYLAPNGHTIGTVGDVMQSEKLSELYNAPVTVARINDRIVVV

SEQ ID NO: 6392 - protein, 185 aa, Corynebacterium glutamicum
MLFIHLYPGRSSTAFSLLTGQIVGVSSSSLWILVAVTVIVVSAVVIFWRPLLFASADPIMAQASGVNVRFIAVAFAVLVGLTTSQSVQIVGALLVMALLITPGAAAVAVTANPVKAVVLAVIFAEVSAVGGLLLSLAPGLPVSVFVTTISFVIYLVCRLIGWLRGRGAQRDEDAYRRRQHDHHPH

SEQ ID NO: 6393 - protein, 500 aa, Corynebacterium glutamicum; identical to SEQ ID NO: 4296

SEQ ID NO: 6394 - protein, 67 aa, Corynebacterium glutamicum
MHKDMTLGVHNVLTLYKGKPDRRDKNLDFRQVLARLSGLGDWKPDTRDRTSSFSPILSRLSGLPREG

SEQ ID NO: 6395 - protein, 563 aa, Corynebacterium glutamicum
MKHQYDVIVVGSGAGGLSAAVSAAYGGKKVAVIEKASVLGGATTWSGGWAWTPGTSLARKDGVVESKEEFQTYLQAVVGEYYQEDNISAFLDAAPEMVDFFEKNTDLQWTPGAKINDIYGNLPGAGTGHRSVGPKPFNGRKVPKSVLPKLRHQLYETSFLGMGIMAGPDLTKFLSASQFDPRGWVHAARRVIVHMWDMVVHKRNMQMVNGAALTARLATSADKLGVDLLVNHSAVSLNYKNDRVTGVKVQTPQGLVDFEATAGVVLATGGFPNNVDLRKELFPRTPSGQEHWTLAPAETTGDGLSMAREIGAGFVNDLKSPAAWCPVSLVPYFNGKVGTFPHIMDRAKPGSIGVVSTGKRFVNEANGYYDYVDAMLKAAPEGEPVASWQIADSTFVRKYPLGMAKPLPVPLTPYLRSGYLVKGKTIEELAQKCGIDPAGLRATVTEFNENARRGEDPEFGRGSTSFNKYGGDPKIGPNPSLAPIEKGPFYAVKVVPGSFGTFDGIKADGKSRVLRDDDTIIDGLYTAGNDRASIMGGFYPAGGINLGPALAFGYIAGKELANS

SEQ ID NO: 6396 - protein, 249 aa, Corynebacterium glutamicum
MRLAAATGFSFVGLRVIAVTPNERVYDLSPGSPLLAATQQALKETALYVLDTEFLQVNADTTREAWLPALEAAGALGAKTFTIAAGDDNIAPLTDTIGAMVDDARDFGVTPALEPISYRSVHSIPQAAAIARDSGGKVVADTLHMARFGATPEELTDVTDVLGVLQLCDSPLQRPADLDGLVTESRSLRLAPGEGEQNLLTFVNALDSNVPLSVETPNDGEVASRGDAGWINHLYNTTQALLEKIEEAV

SEQ ID NO: 6397 - protein, 206 aa, Corynebacterium glutamicum
MGQCTVALYREHSYYTATPWRGTWAADGGGVLMTQAIHYIDLLYWLLGEPVEVFGYTNSFKHGDNIEVEDSAVATVRFESGALATISATTAAEPALGAQVQVMGTKGATMTILEFPEGTDGRLIVRSENDTVETTPSHPADLYPNADLSIINGALIPYHTAQIADFIDALNEGRPPLITGRDATRALKVLLGVYESAATHQPVSLI

SEQ ID NO: 6398 - protein, 145 aa, Corynebacterium glutamicum
MSDKIWKVGIIGCGAISRNHIEAVQAIPGAEVSAVCDVDGAKASETAAKYGISPSFTSVDEILASGVDIVAVCTPHPTHETVVLAAAAAGVHVLCEKPIAIELDSAQRMIDACESAGVQLGVLFQRRFWPAAQKMKKEPSWANAR

SEQ ID NO: 6399 - protein, 285 aa, Corynebacterium glutamicum
MEHSPEGKRGFFTSSVMAGCSVGNVLAGLVFIPFLMLPEEHLMSWGWRVPFLLSALVLVVAYFVRTRLEEASTEKAEEDAGAPALAVLRTQGIDVARVFLITFFAVVQTTFNVYALAYAANEIGIDRSFMVMVNTIALGLSIGTIPLAAWVSDRIGRKPVLLFGAITCAITTYFYFQAISEADLVLIFALCLVNQGLFYSCWNGVWTIFFPEMFASSVRYTGMAMGNQLGLIIVGFAPTIATALYAWNGWEAVAGFIIGAIALSAAVILTTKETAFTKLEDLGKK

SEQ ID NO: 6400 - protein, 142 aa, Corynebacterium glutamicum
METVRTATAAPETASLKLREAESPAKSPKKAALASLLGSTLEYYDFVIYGTASALLFNHLFFPQGDPVVATIGSLASFGVAYIARPIGGLVMGHVGDKISRKTALMVTLMIMGIASISIGLLPTYGQIGIWATVLLMIARIA

SEQ ID NO: 6401 - protein, 218 aa, Corynebacterium glutamicum
MPSSTAHRLVVELTSVKLLERFSDGKYGIGTHAWETFVRANPLERMRLQAQTILSDVREELGQYVCLAVPDFVDRTILYVERFDSTDSQLRLLGRHAGRLDLHTTSLGLVMLAFASPQTIKAVTSSPFKDSISGDITDGAAVAAMLPEIRATGHFVFVGGLIPENTAVAAPVFDRKGVVRASVGVVARNDEIDVNQAVSVVLDACQKLSVRLQKDSLY

SEQ ID NO: 6402 - protein, 313 aa, Corynebacterium glutamicum
MAGNDSRRGGLRKTNKKGATKGSGGQVRRGLKGKGPTPKAEDRTYHAAHKRKVERDRRDRGRHQREMPELVVGRNPVLECLHARVPATALYVAEGAANDERLSEAVHTAAGRNLPVLEVNKLELDRMTGNGMHQGIGLAIPPYEYADVHDLIANAAASKKPGMFVILDNITDPRNLGAVIRSVGAFGGNGVIIPERRSASVTAVAWRTSAGTAARVPVAKETNMTRVVKEFQQNGYQVVGLDAGGDHTLDTYDGTDNVVIVVGSEGKGISRLVRENCDTIMSIPTEGWVESLNASVAAGVVLSEFSRQRRIKG

SEQ ID NO: 6403 - protein, 460 aa, Corynebacterium glutamicum
MTLRIFDTGTRTLRDFKPVQPGHASVYLCGATPQSSPHIGHVRSAVAFDILRRWLMAKGLDVAFVRNVTDIDDKILTKASENGRPWWEWVSTYEREFTWTYNTLGVLPPSTEPRATGHVTQMIKYMQRLIDNGFAYAVDGSVYFDVAAWSKAEGSDYGSLSGNRVEDMEQGEPDNFGKRGPQDFALWKAAKPGEPSWPTPWGDGRPGWHLECSAMATYYLGEQFDIHCGGLDLQFPHHENEIAQAHAAGDKFANYWMHNHWVTMAGEKMSKSLGNVLAVPEMLKQVRPVELRYYLGSAHYRSVLEYSESALSEAAVGYRRIESFLERVGDVEVGEWTPGFEVAMDEDIAVPKALAEIHNAVREGNAALDKGDREAAEKLASSVRAMTGVLGFDPVEWGSDAGADGKADKALDVLISSELERRATARAEKNWAVADEVRDRLADAGIEVVDTADGATWKLQ

SEQ ID NO: 6404 - protein, 661 aa, Corynebacterium glutamicum
MDHKDLAQRILRDIGGEDNIVAAAHCATRLRLVLKDTKDVDRQSLDDDPDLKGTFETGGMFQIIVGPGDVDHVFKELDDATSKDIAVSTEQLKDVVANNANWFSRAVKVLADIFVPLIPILVGGGLLMAINNVLVAQDLFGPQSLVEMFPQISGVAEMINLMASAPFAFLPVLVGFTATKRFGGNEFLGAGIGMAMVFPSLVNGYDVAATMAAGEMPMWSLFGLDVAQAGYQGTVLPVLVVSWILATIEKFLHKRLKGTADFLITPVLTLLLTGFLTFIAIGPAMRWVGDVLAHGLQGLYDFGGPVGGLLFGLVYSPIVITGLHQSFPPIELELFNQGGSFIFATASMANIAQGAACLAVFFLAKSEKLKGLAGASGVSAVLGITEPAIFGVNLRLRWPFFIGIGTAAIGGALIALFNIKAVALGAAGFLGVVSIDAPDMVMFLVCAVVTFFIAFGAAIAYGLYLVRRNGSIDPDATAAPVPAGTTKAEAEAPAEFSNDSTIIQAPLTGEAIALSSVSDAMFASGKLGSGVAIVPTKGQLVSPVSGKIVVAFPSGHAFAVRTKAEDGSNVDILMHIGFDTVNLNGTHFNPLKKQGDEVKAGELLCEFDIDAIKAAGYEVTTPIVVSNYKKTGPVNTYGLGEIEAGANLLNVAKKEAVPATP

SEQ ID NO: 6405 - protein, 433 aa, Corynebacterium glutamicum
MCGAMHTELSSLRPAYHVTPPQGRLNDPNGMYVDGDTLHVYYQHDPGFPFAPKRTGWAHTTTPLTGPQRLQWTHLPDALYPDASYDLDGCYSGGAVFTDGTLKLFYTGNLKIDGKRRATQNLVEVEDPTGLMGGIHRRSPKNPLIDGPASGFTPHYRDPMISPDGDGWKMVLGAQRENLTGAAVLYRSTDLENWEFSGEITFDLSDAQPGSAPDLVPGGYMWECPNLFTLRDEETGEDLDVLIFCPQGLDRIHDEVTHYASSDQCGYVVGKLEGTTFRVLRGFSELDFGHEFYAPQVAVNGSDAWLVGWMGLPAQDDHPTVAREGWVHCLTVPRKLHLRNHAIYQELLLPEGESGVIRSVLGSEPVRVDIRGNISLEWDGVRLSVDRGGDRRVAEVKPGELVIADDNTAIEITAGDGQVSFAFRAFKGDTIER

SEQ ID NO: 6406 - protein, 253 aa, Corynebacterium glutamicum
MDIIICKDEQEVGKAAAALIAPFATKGGTLGLATGSSPLSTYQELIRMYEAGEVSFKNCKAFLLDEYVGLTRDDENSYFKTIRKEFTDHIDIVDEEVYSPDGANPDPYEAAAEYEAKIAAESVDVQILGIGGNGHIAFNEPSSSLSGLTKVQALHPKTVEDNARFFNTIEEVPTHALTQGLGTLSRAQNIVLVATGEGKADAIRGTVEGPLTAMCPGSILQMHNNATIIVDEAAASKLENADHYRLMEQLKLR

SEQ ID NO: 6407 - protein, 384 aa, Corynebacterium glutamicum
MHYQENAGQAVKKIEGRIVTPHGVIDGFLQLENGIITELSGEPAPKNAGFHPELPTIVPSFIDLHNHGGNGGAFPTGTQDQARNAAQYHREHGTTVMLASMVSAPADALAAQVENLIPLCEEGLLCGIHLEGPFINACRCGAQNPDFIFPGNPTDLAQVIHAGKGWIKSITVAPETDNLTELLDLCAAHHIIASFGHTDADFDTTTSAIALAKEKNVTVTATHLFNAMPPLHHRDPGSVGALLAAARAGDAYVELIADGVHLADGTVDLARSNNAFFITDAMEAAGMPDGEYILGVLNVTVTDGVARLRDGGAIAGGTSTLASQFVHHVRRGMTLIDATLHTSTVAAKILGLSDHEIVKSNPVNFVVFDSNGQLQQVHLDHQVI

SEQ ID NO: 6408 - protein, 312 aa, Corynebacterium glutamicum
MASATFTGVIPPVMTPLHADGSVDVESLRKLVDHLINGGVDGLFALGSSGEAAFLTRAQRKLALTTIIEHTAGRVPVTAGVIETTTARVIELVEDALEAGAEGLVATAPFYTRTHDVEIEEHFRKIHAAAPELPLFAYNIPVSVHSNLNPVMLLTLAKDGVLAGTKDSSGNDGAIRSLIEARDDAGLTEQFKILTGSETTVDFAYLAGADGVVPGLGNVDPAAYAALAKLCLDGKWAEAAALQKRINHLFHIVFVGDTSHMSGSSAGLGGFKTALAHLGIIESNAMAVPHQSLSDEETARIHAIVDEFLYTA

SEQ ID NO: 6409 - protein, 303 aa, Corynebacterium glutamicum
MTDPTCTLALDIGATKIAYALVPDNTPTTTLSTGRLGTKEGDSPIEQIRLVLLAGLKAAEEHGLSVARIGMGAPGVILGPEGTIVYNGETLTEWAGTDLRGLSREVLNVPFAAHNDVRVWAYGEHHLGTGKDLTGRVLYVSLGTGVGGAIIEDGIMMSSPTGTAGEFAEVVCSDHAGLAVRCENVASGTGLTRYYNEAAATQLDLPAIMERFHQGDGLAQQIITGNLRGFGQALGALVTVLDLSAVVVGGGVAGIGAPVMDPITAGIFDRVLTPNKSVQVLSTSLGAQAAVIAAAKYARDNAF

SEQ ID NO: 6410 - protein, 232 aa, Corynebacterium glutamicum
MDLNTQRSKLYAQLQGQLIVSVQAPDGHAMRDTHTLTHVAAACVDGGAPAIRCGGYGGLEDIRSISNRVDVPVFGLTKEGSEGVYITPTRDSVRAVAESGATVVCADATFRPRPDGSTFAELVTVAHDSGILIMADCATPEEVLSAHKAGADFVSTTLAGYTEHREKTVGPDFDCLREARELVPDAFLIGEGRFSNPADVAHGRLIGANAIIVGTAITDPGFITGQFASLLH

SEQ ID NO: 6411 - protein, 59 aa, Corynebacterium glutamicum
MLGRFWGRWALRSDSGTVVFGATEAGVIPVWLLGVSRARIHHIPEESWNLWWILALLGR

SEQ ID NO: 6412 - protein, 405 aa, Corynebacterium glutamicum
MRTSLIARGLYRIPALVWDQGLLTLFDARLSVDDLPAPIDVVSARSSDGITWTTPEPAIVETEHRGVGDVCLVTGDLCFHGLSNLAGFFEDPTDLEPRLARRDVSGWTSISMAHYFADVDAAFASSGTGLVLADGRWIQSFVVRRGREISLRILRSDGHITDIAGGNESAMTQLPSGRIVLHSRGVGHRLSSVSDDFGETFTPLEPVPELIDPGCNGHVFYWKAAGMLAATHLADPDLRRHLVVDLSSDEGATWAHRITIEREEAAYSTAAEMPNGDVAVVWEAEGTRAIKCTVISVNDISLRIDEPISDAISLRHVVINDDHDGIEVALPDASQWGEGVFKIVSNPDASTQKIRTRGKPARQTLEIGDELVFDIRKGGEVAYGVTVPYDGRSLGEVKQDFGVGL

SEQ ID NO: 6413 - protein, 243 aa, Corynebacterium glutamicum
MNTMESSKKTSRSRSTTQEAVRDIKKYIRDNRLRTGDLLPSEAFLCEELGCSRSAIREAIRALVTLDIVEVRHGYGTFVSRMSLEPLINGMVFRTVLDNDTSVENLFYVVDTREILDLSLGEELIEVFTDDDRELLLDLVDKMREHNDQGESFVVEDQKFHRALLARTKNPLIRELNDAFWQIQTEAQPMLNLAMPADIDETIKAHSDIVEALSSGNIDDYRSAVLAHYAPFRRMISNMLDAH

SEQ ID NO: 6414 - protein, 536 aa, Corynebacterium glutamicum
MSTTITRRNFLRATGILGVAAGIGATLAACAPDNTGTSGSTSTAAGTGTANEEGTITAAISYELGTNGYDPMTTTSALTVAANWHTLEGLTEIDPATGEVYAALASALPSADATSLDIKLRDGATFHNGDAVTADDVVFSFERVLDPANNSLYASFIPFIKSVTKKDDTTVTIDLDYATGIISERLAVVKIVPKSVVEADASGFDANPIGSGPYKMTDNGASKVVKFERNDDYNGPRPARAAKMEWQIIPDASTRTNSLQSGSTMAIDSVPYLSIPQLEATSTVESVQGFGLLFAMFNCSEGNPFNDVRNRQAFLYALDMDKIVKTGMSDQATPATSFVQKEHPNYNQASTVYSLDADKAKALFAETGLTSLNLLCTDHDWVKNCTPLIQESLAALGINVSFTERKSADVYNTIDGKPEAYDVVIAPGDPSVFGNDPDLLMRWWYAGDVWTDSRMHWKGSESYDQVQNLLEEGIRATDKAEQQDIWNRTFDVISDNVPLYPLFHRKVPTAWNSNALVDFKPISLTGLNFSGVATTE

SEQ ID NO: 6415 - protein, 317 aa, Corynebacterium glutamicum
MRLVGRRLIALPIMIIGVTLLVFIVMSFSPADPARLALGESASPEALEAYREANGLNDPMMVRYFDFILGMLKGDLGTSSGGVAVTDIVARAFPITLQLTFWGLIIAVVVALILGVIAALYRDRWPDQLIRVVSIAALATPSFWLAILLIQWLGTIPGAWGFFPALVTRWVPFSEDPATYFNNIALPAIALAVPVAGSLARVVRTSMVEELDKDYVRTAIGAGIPKTEVVARNVLRNALITPITVIGLRVGYLMGGAVIIEIIFNIQAMGQLILDGVTRNDVYLVQGVTLTVAIAFIIVNIAVDLLYVLVNPRIRSI

SEQ ID NO: 6416 - protein, 356 aa, Corynebacterium glutamicum
MLGHTTREEANASLLASLAALSTSENNSNNRLIFDGNPTPLLEVRDLKISFPNAHGDINIVDGVNFTVAPGQTMGLVGESGCGKSITAMSIMGLLPPTAKIEGEILFDGKNLLDLKPDELNALRGHEIAMIYQDALSSLNPSMLISAQMKQLTRRGGKRSAEELLELVGLDPKRTLQSYPHELSGGQRQRVLIAMALTRNPRLLIADEPTTALDVTVQQQVVDLLNELREKLGFAMIFVSHDLALVARLVHKLTVMYAGQVVEQGTTREILIDPRHEYTRGLLGSVLSIEAGVDRLYQVPGTVPSPKEFVAGDRFAPRSEFPELGLDQKPVLRPITGTEHAYAATDELLAAKGEQR

SEQ ID NO: 6417 - protein, 272 aa, Corynebacterium glutamicum
MTSTIDTRQPILVLRNTNVIHKTRTGKLFRPDQVHANKNINFKAYRDEVIGIVGESGCGKSTLARVMVGLQPVTSGEVLFKGKPMKPRGAQRKELGSSVSVVFQDPATSLNPRMTVREQLLDPLRVHKVGDEASRNQWVSELISMVGLPQSALEVLPRQVSGGQRQRVAIARALALKPDIIVADEPTSALDVSVRAQVLNLLLDLKTELGLGLVFISHDINTVRYVSDRIAVMLAGEIIEENTTSEIFNNAQQDYTRTLLEATPSLLNKTRL

SEQ ID NO: 6418 - protein, 207 aa, Corynebacterium glutamicum
MDAASWVAFALALLVALAVPGPDLVLVLHSATRGIRTGVMTAAGIMTGLMLHASLAIAGATALLLSAPGVLSAIQLLGAGVLLWMGTNMFRASQNTGESETAASQSSAGYFRGFITNATNPKALLFFAAILPQFIGNGEDMKMRTLALCATIVLGSGAWWLGTIALVRGIGLQKLPSADRIITLVGGIALFLIGAGLLVNTAYGLIT

SEQ ID NO: 6419 - protein, 161 aa, Corynebacterium glutamicum
MKQDQSPKLDSVDWKILELLQVDATMPNKDIAAKVGIAPSTCLERIRRMRRNGTIVATRAHVRPSLLGRGEQAFLGIQIRPHARDTANDFVQKVLALPETLALYNVSGSEDYLVHVAVANSTELQSLIIDKLLALPQVAHCRTQLIFGEPWVAPLRQSDGQ

SEQ ID NO: 6420 - protein, 120 aa, Corynebacterium glutamicum
MPKLSSPKVWNLVAIIVLGGMATEQILGFRDNNSTALVMWISSAIAIGAVVWGLSNYKKPCDWFIPRLYAFAAVPNLMLLFDAQSWTKFWGGLAGAVIFTLILSGFLALYKDFHKSPKRK

SEQ ID NO: 6421 - protein, 160 aa, Corynebacterium glutamicum
MTNPIIPRVGIATDAHQIEAGKPCWIACLLFEGVDGCEGHSDGDVVAHAIVDALLSASGLGDLGSFVGVGRPEYDGVSGTQLLKEVRELLSAHGYVIGNVAAQLVGQTPKFGPRREEAQQVISEIIGAPCSLSATTTDHMGFTGRSEGRASVATAVVWKA

SEQ ID NO: 6422 - protein, 256 aa, Corynebacterium glutamicum
MSSTRIPVIALLAAAGRGTRLGGPIPKAFVTLRERTLLERSLQAMLTSESVDEIIILVSPDMETYARDLLRKRGLLNDPEGVRVRLVHGGGERADSVWAGLQAISLDDATPDAIVLIHDSARALTPPGMIARVVRKVHEGATAVIPVLPVSDTIKRVSPDGGVVVDTPNRAELRAVQTPQGFLLSELVAANEKFFADPNPGFIPTDDASLMEWYGADVVCVQGDPMAFKVTTPIDMMLAQRITDEAEPTIFEVPGD

SEQ ID NO: 6423 - protein, 198 aa, Corynebacterium glutamicum
MEFKVGDTVVYPHHGAAIISALEQREMNGETVDYLVLQINHSDLVVRVPAKNAELVGVRDVVGEEGLQKVFSVLREIDVEEAGNWSRRYKANQERLASGDVNKVAEVVRDLWRRDQDRGLSAGEKRMLSKARQVLVGELALAETVDDEKADAFLSQVDETIARHRADLLGDEEEKKDAFDDFDDSDVDLDDLSFDDED

SEQ ID NO: 6424 - protein, 241 aa, Corynebacterium glutamicum
MTNPSPALNETLSGRVLIVEDERPLARMISLYLSKAGFDTTTIHDGAAAPDKVAHLRPDVVILDLGLPGLDGLEVCKRIRAFTDCYILMLTARGSERDRITGLEIGADDYITKPFNIRELVIRIQSVMRRPRKIDETIQNGLTLTYGHIELDTLAHEVTVKGVGVTLTRTEFELLQALMHKPGEAVSRRDLVSQVWDTTWVGDERIVDVHIGNLRRKLEAPAPGSHFIDTIRGVGYRMAFK

SEQ ID NO: 6425 - protein, 372 aa, Corynebacterium glutamicum
MTALIPARHSLTFRLLTAQLAVVLISLLAALIVAALVGPAIFNSHLDLSGPIDPRQTDFHIQEAYRDANYIALAAALPTAVLSSIGVSFWLSHRLGQPLWRLSRAATAMSSGDYQVRVPISDVDKEVAALSLAFNSMADQLEHTEELRRNMLSDLSHEMNTPLSVLLVYVDGLQDGMVEWDADTHAVFAEQLGRLSRLTSDLDDVSRAQEHRFDLVYSTVAIGGLIHNAAGAAAGSYQEKGVALEVTGSDSTELIRVDSQRFAQVMANLFSNALRHTPAGGKVHVRVLRQGVGTIVIEVIDNGEGIAPEHVKYVFERYFRAKRSDSDDQSGSGIGLTISRALIEAQGGTLTAESAGLGKGAKFTIRLPLLSK

SEQ ID NO: 6426 - protein, 194 aa, Corynebacterium glutamicum
MEDESVKSLNLAARRGALVTVAAASALALASCSAGQITQTSSQVAAVDGNQAGSANDPVLVRDVTVHLTTDGEAGVKFTAINQDTSHTSHTLESVTVDGEEVELDDAEPIERNCSLVADIQSELDLIEEPEVGCIQHVATSLENPGFAYGGVVPVEFVFDTGAITIDATVSAPVLESGVENREVGGDTAEASHH

SEQ ID NO: 6427 - protein, 464 aa, Corynebacterium glutamicum
MAKKVRSVHECSECGYSSPKWLGRCPECGSWGSMEERTVGESGGAARAAVSGAAPAGLTPTSPAVPIGKIVASQATSISTGIGELDRVLGNGIVPGSVVLMAGEPGVGKSTLLLEVASRWASMKEGDGTRTALYVTAEESAGQVRLRAERTAAVKDTLYLAAESNLDVVFGHVNQVKPSLLIVDSVQTMHAAGVEGVAGGVAQSRAVTAALTTLAKTSGIPILLVGHVTKDGNVAGPRVLEHLVDVVLNFEGDRHSSLRMLRGIKNRFGATDEVGCFEQQSDGIKEVPDPSGLFLSHRGSTPDGTAVTVAMDGVRPLLAEVQSLLVDAPSKNPRRVVTGLDANRVPMVLAVLSARAGRQTQGKDAYVATVGGMKVGEPATDLAVALATASALAKKPLPDKTVVLGEVGLAGEIRRVPNVDRRLAEAERLGYEKAVIPGGSGIKQTSLRVIEASTLAEALAAVSL

SEQ ID NO: 6428 - protein, 366 aa, Corynebacterium glutamicum
MTPTTTPVSNPDALSTGTQDVHTLKGTLQRLAPGTPLRDGLDRIVRGHTGALIVIGDDENVSSICDGGFEFDVSFAATRLRELCKMDGAVILSSDLERIKRANVQLLPSPTWPTQESGTRHRSAERTALHTGVPVIAVSESQNTITLYVEGKSHMLEQPAALLNRANQALGTMERYRDRLDQVNNRLHLAELHSYVTVIDVVSVIQREEMLRRVGEIIDGDVLELGKDAKEIQIQLSELRGDNDRERESIIADYLVTDGIPADEEIHAALEAISHLDDKALLNPANIARVLGLPPTEEALDEPVTPRGYRTLNRIPRVQKFLMDKLIVEFGNLDALLNASVEDLSAVDGVGSLWARHITDGLGRLS

SEQ ID NO: 6429 - protein, 229 aa, Corynebacterium glutamicum
MFCVGTPRHNEVIYKRRRMAALLVLLVVIALIIWAVVALRGGSSEPEEEQPNNAVVTSSMESSTTSSSSSKESTTEATTEEETSSAEPTATSTVAADAKKTCELSDLVISASTNQPTFSGSAQPELFMAVHNPTAVDCEIDLEENKLRFEVYNLATNARIWSDVDCNPAVEDGTSVFPAGEDRYFQATWSRTTSAPNQCNNRTDVPAGGYYLHTVVGNNPSPAVTFNLT

SEQ ID NO: 6430 - protein, 484 aa, Corynebacterium glutamicum
MTATFAGIDATKHLIGGQWVEGNSDRISTNINPYDDSVIAESKQASIADVDAAYEAAKKAQAEWAATPAAERSAIIYRAAELLEEHREEIVEWLIKESGSTRSKANLEITLAGNITKESASFPGRVHGRISPSNTPGKENRVYRVAKGVVGVISPWNFPLNLSIRSVAPALAVGNAVVIKPASDTPVTGGVIPARIFEEAGVPAGVISTVAGAGSEIGDHFVTHAVPKLISFTGSTPVGRRVGELAINGGPMKTVALELGGNAPFVVLADADIDAAAQAAAVGAFLHQGQICMSINRVIVDAAVHDEFLEKFVEAVKNIPTGDPSAEGTLVGPVINDSQLSGLKEKIELAKKEGATVQVEGPIEGRLVHPHVFSDVTSDMEIAREEIFGPLISVLKADDEAHAAELANASDFGLSAAVWSKDIDRAAQFALQIDSGMVHINDLTVNDEPHVMFGGSKNSGLGRFNGDWAIEEFTTDRWIGIKRS

SEQ ID NO: 6431 - protein, 49 aa, Corynebacterium glutamicum
MAHQFDRCGNYHNSRPEQRKSDLAESIPTAVNATQPYGPFGNPGPQIDL

SEQ ID NO: 6432 - protein, 207 aa, Corynebacterium glutamicum
MPLRNVDRTPPAVWEALLAGNERFISFNEDRPNQDAPRRRELRNGQTPAAVVISCSDSRVPVEIIFDVGLGDLFVVRTAGEILDQAVLASIEYATESIGVPLVIVMGHESCGAVAATAAALEGGALPGGYQRVLVEKVAPSILEAKAEGLSSIKEFEEHHVVATVNQLLSRSPEIHQKVETGELGIIGLRYRLSDGRTEPVISKNVG

SEQ ID NO: 6433 - protein, 293 aa, Corynebacterium glutamicum
MSFTAFQTALLVWFRANARDLAWRDPNTSAWGILLSEVMSQQTPVARVEPIWREWMEKWPTPEDFANASTDEILRSWGKLGYPRRALRLKECAEVIVEKHAGEVPDTVEALLALPGIGDYTARAVAAFHFGQRVPVVDTNVRRVYQRAVAGRYLAGPAKKQELIDVSLLLPNTHAPEFSAAIMELGALICTATSPKCDTCPLLDQCQWQKLGCPSPSEEELASAKKRVQKFVGTDRQVRGLIMDVLRNATAPVPLSAIDVVWPDDAQRSRALFSLIEDGLAEQNEAGYFHLPR

SEQ ID NO: 6434 - protein, 385 aa, Corynebacterium glutamicum
MLGLSRRKFAMLAALTAGIVGVVATGCSTPAEPETIDNPVFIGISIDPIKNLSPNHAANLFALSADGSGGIFQELAPTYFPSIHRLGNGFIAPDRDSLVVVDASLKEVYRHEVARLGVGMQTQSARSPLHKSVAFSFNEGTAEAPYRHRIVSATEKTSASAMTDQRHFALTACDDGSTRWVEYSPDRGMEDPMGPGSARIVTLQADGELSEIDVEWNFPDRPSAPIILSCEDPSAYIVSEEDIIYVKDEVSPAESIGKLPAYEIPDRARFDTVSGEDYFAFTSTGMLTRINIPQAKIVYAQSIDLYGKHPVSITFDSDRAYVVTSGDSGESLLEIDLNDPTCTSDQLSLTGFNKLLTARKPKPEPSIIIETILPIDPNYSLGCKS

SEQ ID NO: 6435 - protein, 102 aa, Corynebacterium glutamicum
MLPQNKFSRFKALYSLSNLQRPSVATIDQQKYFCTHHVMKIMLVHMGLNYRKIIKTGKDSWLNVSKSGVSGSKRIGPVTINSRGGISVKLPGGLNYRGRWKK

SEQ ID NO: 6436 - protein, 258 aa, Corynebacterium glutamicum
MSKVAMVTGGAQGIGRGISEKLAADGFDIAVADLPQQEEQAAETIKLIEAAGQKAVFVGLDVTDKANFDSAIDEAAEKLGGFDVLVNNAGIAQIKPLLEVTEEDLKQIYSVNVFSVFFGIQAASRKFDELGVKGKIINAASIAAIQGFPILSAYSTTKFAVRGLTQAAAQELAPKGHTVNAYAPGIVGTGMWEQIDAELSKINGKPIGENFKEYSSSIALGRPSVPEDVAGLVSFLASENSNYITGQVMLVDGGMLYN

SEQ ID NO: 6437 - protein, 108 aa, Corynebacterium glutamicum
MKSKKLLSVLTAVALSGGVVTTTAIVSPSIVSAAETMTDQYDPFYDDTTVRAVPWVLLYPQGEKRLPSGTTFSLFDSTSYSPEVFSDGAVMIKLTPSSGQLHVWLNSL

SEQ ID NO: 6438 - protein, 247 aa, Corynebacterium glutamicum
MVAEYPDGSSEIFPVTLNLIPEDTLVYDAVYKFKSIRTGSEDQITPFVSNQPDVPFPAGTSFTLTGYYEIDQLRSAGWKFELNPVTGELSVTVPISVIYPDGSRDNTIATMESVGPDDSELFKPDFDLIPIKSGDYIEIGVLAPGLPAGTEFHLDYYALPDRFFDLGGSTSLSGNGKFSLGVPLTWNDDLQLPISITFPDGSHTVENLHVDVTPANFAGNPIDEPKDDDKDHPQPAPKPSGSSFGSS

SEQ ID NO: 6439 - protein, 104 aa, Corynebacterium glutamicum
MTMPRQGLLAFQRNHIETKNFHAHATLFIISMVTGRAGIRPCLIVFAGIPTSNYEVAILTKLWTQQLKFLESFGRIYSLLTSREALFDFFFSPCRERKSRDVNK

SEQ ID NO: 6440 - protein, 97 aa, Corynebacterium glutamicum
MSFVNITALTFPAGAEKEIEQRFAARKKAVDTAKGFQEFELLRPQFGEDRYFVVTRWDSREDYQAWSDARPAGNHADDEQRGMSVEVLGFDVVPLEG

SEQ ID NO: 6441 - protein, 140 aa, Corynebacterium glutamicum
MSIWMRESSSPKRNPARALDSSVLPTPDGPAKMKEPEGRLGSFRPARVRRIARETALTASSCPMMRLCNSSSMLSRREDSASVSLKTGIPVQLASTSAICSSPTSAMSSRSPERHCFSFSERSSPSLRSLSRRPAAFSKS

SEQ ID NO: 6442 - protein, 71 aa, Corynebacterium glutamicum
MCLRYSSRVVAPMVCSSPRASFGLSREAASIAPSAAPAPTRVWISSINRMMSPRWLISLRTFFSRSSKSPR

SEQ ID NO: 6443 - protein, 107 aa, Corynebacterium glutamicum
MSSARPSTTAVLPTPGSPIRTGLFLVRRESTCMMRSISLSRPTTGSSLPSFAAWVRLRPNWSRTKEVERSPGLPEDGRPPGAAPAPTASPPVGAPWPPSGDPPWPPS

SEQ ID NO: 6444 - protein, 925 aa, Corynebacterium glutamicum
MFERFTDRARRVIVLAQEEARMLNHNYIGTEHILLGLIHEGEGVAAKALESMGISLDAVRQEVEEIIGQGSQPTTGHIPFTPRAKKVLELSLREGLQMGHKYIGTEFLLLGLIREGEGVAAQVLVKLGADLPRVRQQVIQLLSGYEGGQGGSPEGGQGAPTGGDAVGAGAAPGGRPSSGSPGERSTSLVLDQFGRNLTQAAKDGKLDPVVGRDKEIERIMQVLSRRTKNNPVLIGEPGVGKTAVVEGLALDIVNGKVPETLKDKQVYSLDLGSLVAGSRYRGDFEERLKKVLKEINQRGDIILFIDEIHTLVGAGAAEGAIDAASLLKPKLARGELQTIGATTLDEYRKHIEKDAALERRFQPVQVPEPSVDLTVEILKGLRDRYEAHHRVSITDGALTAAAQLADRYINDRFLPDKAVDLIDEAGARMRIKRMTAPSSLREVDERIADVRREKEAAIDAQDFEKAAGLRDKERKLGEERSEKEKQWRSGDLEDIAEVGEEQIAEVLANWTGIPVFKLTEAESSRLLNMEEELHKRIIGQDEAVKAVSRAIRRTRAGLKDPKRPSGSFIFAGPSGVGKTELSKALAGFLFGDDDSLIQIDMGEFHDRFTASRLFGAPPGYVGYEEGGQLTEKVRRKPFSVVLFDEIEKAHKEIYNTLLQVLEDGRLTDGQGRIVDFKNTVLIFTSNLGTADISKAVGLGFSGSSETDSDAQYDRMKNKVHDELKKHFRPEFLNRIDEIVVFHQLTKDQIVQMVDLLIGRVSNALAEKDMSIELTEKAKDLLANRGFDPVLGARPLRRTIQREIEDQMSEKILFGEIGAGEIVTVDVEGWDGESKDTDRAKFTFTPRPKPMPEGKFSEISVEAAEAIQDVDSAADGDVPETDSLSDIDLETLEKFEEDVENGTDIDQVSGDYYGTDDQGGTAPSKE

SEQ ID NO: 6445 - protein, 477 aa, Corynebacterium glutamicum
MRFLNNSNPPYELTYSDVFMVPSRSDVGSRMSVDLRTNDGTGTTIPLVVANMTAVAGRRMAETIARRGGMAILPQDVPADIAAETIANVKKADLVFDTPITVKPHHTVGYARNLIHKRAHGAAIVLEGDQPVGIVTDKDLEGADNFTQVGTLMSTSLLTLPEDISPEDAFGILHEHSRKLAPVVAADGSLRGILTRTGALRATMYKPAIDANGRLRVGAAIGINGDIEGRTKTLLDAGADVLVVDTAHGHQSTMISALKRIRALDVNVPIVAGNVVTADGVRDLVEAGANIIKVGVGPGAMCTTRMQTGVGRPQFSAVLECAAEARKLGAHVWADGGVRDPRDVALALAAGASNVMVGSWFSGTYESPGDLRFESDGRMYKESFGMASRRAVESRNQKVEAFEKARRAMFEEGISTARIYIDKRHGGVEDLVDQIISGVRSSFTYAGADSIETFFERATVGVQSTEGYAEGKPRASR

SEQ ID NO: 6446 - protein, 337 aa, Corynebacterium glutamicum
MTAQPAHEPPRHLRFSTSGILPDNRVQMWEGHNARALLPLDIRTIDDRPMQASETNLHLPSMRMASVFGTSQFVERSESFISENPTGVVAIFFATEGEAVFFHRGGHVALRPGQAIVYDADRPFLRGFNNRFRELVLTIPKQRYLEIVGSKGPELPAIFEFGATGTANEQALARLVQESLHRIESGEPKHIDSSGPLGKPWSDIEHEAHGLIRNVLGDATSSEEGLISAAQRFIDINISESDLQASRIAAAVGISERQLSRIFSDSGQTIGRYVLNTRLDFAKEALSTPERDKVSVSEIGKRFGFASPSHFSRTFRERFEMTPLQWRKESQRQSFQE

SEQ ID NO: 6447 - protein, 595 aa, Corynebacterium glutamicum
MDVLIVGAGPAGTIAAAQLSRFPNVTTRLVERSDRRLELANADGVHSRTIETFQAFGFAHEILAEAHEITDMAFWKPDPQNPREIIRDNSTRELPQHISEFPMALLTQTRIIDHFNRFMKNSPTRMKPDYGYEFVDFEVEEDAEYPVIVTLRRTSGEQTGELVTVRTKYLVGADGARSQVRKSLGYRLQGKQANHAWGVMDIHANTEFPDVRKKCTIKSDSGRTILLIPREGGFLFRLYVDLGEVPDDGSKAVRDTPLQDVIDTANQIMAPFTLDVKNVVWNSIYEVGHRVADHFDDRVSEKTSSEHPRIFIAGDACHTHSAKAGQGMNVSMQDGFNLGWKLGHVASGNSPRELLQTYAEEREDIAYKLIEYDKNWSTLMAKPSSEMGSAQDLEDFYRANSEFNAGYMTHYPPSSITMDGSNQDLAKGYPIGRRFKSAMVGRVCDFTETHLGHQATADGRMRAYVFAGSDALNGEGSELDRWAEWAEANLDPTLVDAKVIYQSPYTELDTRQVPSVFKPAVGIFELTNVENSFGITTDSDIFDSREISRDGVVVVVRPDQYVSGIFPLTDTQGLGEFLTGYFPKMKGAHQLINAN

SEQ ID NO: 6448 - protein, 572 aa, Corynebacterium glutamicum
MRSLQSVLDLLTSKSKVATKIVVERIEKHPVHGLGWMMYPPFHPWTDASTLTIERNGTSRRASQNGVAVLHQHEQVQTIGLASYFIDSKIWVNELAGLDRINISESEVAGRDVLVLPLSDLTLSIDAKYGVVLAAEDSDESVRAVSVEFLDQWVDEEEPPAEEVPKYTETREELPPLEIPPAPSGNRNLRVLCTWGAMEGIIPEWKPGDQVSLFLSFDLDDPPFEQLKTTRRGYTEPGEIYGNQRSYKFHADGWNAVISAKVPLRTEENLTGYFTHSSYADTSRRTSAVITAVYRHGKDAIIDVTLDGAKPPRYQESLDWSSTSTCDGETIWLSDKSLPFVRGFNVSTGKLVHEISIPTFNEIALESGNRARAAKKLWELPDLKEATDPVPAIPAGWKLHKRFGKNFHIVSADNGTWKQTILRIKPFKAIELDLGYAKISTIYQYGERIYLRSDLHQITFNQDLEILSVEVHGNPDAGYWPLSDLPPGDSPTLGFPIGSLMMFHEQQDIYAFHDPKTTKQLTTVNLPKRQFEVEYASQNRIVISLKNPESRLIDKLLVWEPQTRWREQNLES

SEQ ID NO: 6449 - protein, 647 aa, Corynebacterium glutamicum
MESVDELLSLIRRGAATTVSMKLQVTRAPSSLHFEGGMRPTQLLKYVNLDGLNIDRSHSTFHVQQDGADVLRGSGNIRWCFEEDDIPYEVDVDDLFILGGLDNFINPLGVIEIMNLHSLEIRQISSGTISERKTWIFPTAARSFNQNLVHPQSIEIDAQTGVILAMENRLQRTEVESVEYPTDLPNPAWTGPAISWPLKDPSIDFPDPLPHSISELPPQSDNPRHLRVSISLDAVEGAFPRYRIGDSIRIPLVFARDTPFMSGLETTRRAWIEAATEMDIHNTWPIILTGDGWTALSHSDKPIRHEAELKGWFFHSLFGSEMPLTDLKIERIYGGLGTFDSGATRWQELTDTDDAYTENGSWLLEVIVDATLDGAIPPPLQPQQFEASITHIVDEQLWVLGQMLPVLRCWDLETGKYLGQTYVPISVSHSSRLQFSEGLIHDYENAWSLNPGVRMLAEPQPWIEPVIELDVPAPWELQESFPDGLYSLTDGEQTALGRSTPAGQLEICVISNDGSRILNAGRVEDLYFVQFWGMTVFLNSNFQVQSAEEHQLGAKRERWITQEGVAAKFTEEDEIVFLDQISGSEITRWKTPEGYFTEVRILSPNHFNILVTPPTGSDYLKPVPSSVSVFRDGQWSNIKFEDVSVEI

SEQ ID NO: 6450 - protein, 574 aa, Corynebacterium glutamicum
MRSFQSILDLVNSASEVATKIVLKRFEKRITSETDWVPYQRFSLWSVGSPLTIERKGPDVRVSKDNTAVLQRYQRPEAEGLISYFMDPKPWITELAGLNLDDVSEDTVAGRTVLVVPLSNVILSIDAEFGMILTAENDIEKIHAISVELLEKWRSSHYPEPHFPAAVLPPASTGNRNLRVLCPEFSIPSVNVGDQVLLFLTFDQTLPPVDQLETTRRGYTDPIQLDYDHRQYRFHADGWDAIISTVEPLHDEEELTGYFLHRLDPDSAYPTIAVVTAAHYHGTDAIIDVTLDGVHPPKNQETLEGISTSTSDGDIFWLSDESLPFVRGFSVSTGELLHEISIPTFQEIVLDSANRARVKQKQWPHDFSDCKGKTWELPDLKEVFEAVPSIPAGWRLLDSFGKNLHNVTRENPRLNDNFWLQTILRLKPFKAVDLDIGRSIITAIYPYGDRIYLRASNHHITFNQDLEILNVEVFGDPEVPESGLIYLPPGDSPTLGFPTGTLMMFHEQEGTYAFHDPETTEQITTVNLDRNSFSVAYSSRTKIVISLKNPESRPTNKLLVWEPQTGWREQNLER

SEQ ID NO: 6451 - protein, 54 aa, Corynebacterium glutamicum
MGIHEWRKGLSQHEAQFLEFSKVAKLSYEKKLLKSATSKCIVQMVVLGVFRRLA

SEQ ID NO: 6452 - protein, 481 aa, Corynebacterium glutamicum
MDSQINTQTSPAAAKLPREVVVVLSILVVSAMIMILNETILSVALPSIMEDFSVPETTAQWLTTGFMLTMAVVIPTTGYLLDRFSTKTIFVTALLFFTVGTLTAALAPTFAVLLGARIVQAVGTALVMPLLMTVTLTVVPAERRGSMMGIISIVISVAPALGPTLSGVILNSLTWHWLFWMMLPIVVIALVIGFFLIKNIGETKITPLDVLSVILSVFAFGGLVYGFSSFGAILEGEGTVGIFAIVVGAIALLIFALRQHQLGKQDKALMDLRAFKVRNFSFSLTTILLAFGAMLGTVMVLPIYLQTSLGVTALVTGLVVMPGGLLQGLISPFIGRFYDKVGPRPLLIPGAIALAIAASSMTFLNENSPVWMVVVMHVVFSIGMCLMMTPLMTTALGALPKHLYGHGSAILNTFQQLAGAAGTAIMIAALSFGTSIAASSGSAHAEAVAAGTKVAFIAGAIIAVIALVVSLFVTRVEEEAH

SEQ ID NO: 6453 - protein, 317 aa, Corynebacterium glutamicum
MKNWQEEFQLVNLTKLLHSDTETSAAISNGQMIKLTHEVAINAEKYRSLPAWDKAAARAFAVGMTVDKAVVAGQSAARLWGYQTLTVEKTVLCLLPERLRSKSSKHWPSGMRYKDRYLSSRDIREVHGIRVTGAFRTFLDIALDDGVVAAVVTIDSARRQNPSLTREKLMHSAESFPRHRGVKAYRQAIELSIPNSDSAQETRARLILREAKLPEIQSVKVQARFDQSHNKYFLVDFLINEWIIVEIDGRSKYDSPELNEVLMAERDREKFFLNQGYAVLRIDPKQLDLNQDGECEFIGILKNTLQKTPPEHLKQAA

SEQ ID NO: 6454 - protein, 526 aa, Corynebacterium glutamicum
MTNSNPTSKNNSADLPEQLRIRREKRERILDSGLDAYPVEVDRTISISDLRSQFVVITEDLQEREEGVTYLEVGEETDVEVAIAGRVMFVRNTGKLCFASIQEGNGTTVQAMLSLAAVGEESLKAWKADVDMGDIVSVRGKVISSKRGELSVMADSWHMASKSLRPLPVAFADLSEDTRVRHRYTDLIMREQARTNALTRIKVMRALRHYLEDQDFLEVETPMLQTLHGGAAARPFETHSNALDIDLYLRIAPELYLKRCVVGGIERVFEVNRNFRNEGVDSSHSPEFAMLETYEAWGTYETGAKLIKGLVQSVAQEVFGTTLVTLADGTEYDLGGEWKVIEMYPSLNEALARKFPGQPEVTIDSTVEELREIAKVIGLSVPENGGWGHGKLVEEIWELLCEDQLYGPIFVKDFPVETSPLTRQHRTKPGVTEKWDLYVRGFELATGYSELIDPVIQRERFEDQARLAADGDDEAMVLDEDFLTAMEQGMPPTSGNGMGIDRLLMALTGLGIRETVLFPMVKPEQK

SEQ ID NO: 6455 - protein, 266 aa, Corynebacterium glutamicum
MSFTHGQGRVFDTVEQIRMFGSALRKTGKPVVLVPLGNGLHAGHIALIRAAKRIPGAVVVVAYAGPESDHARLREELIDAIFPFNPETLWPHGIRVEVTGGPTLTPQGAEVTKVLGLLGITGATDVVLGEKDYELVVLVQRALNDLHIPVKLHSVPTVRMPDGLAISLRNISVPEDSRETALSLAAALTAGAHSAEHGEAVVKETVTQVLKAAGVTPDYVEIRGLDLGPAPEIGDARLFAAITLGDVQLHDNVGLPLGIGFKNIEG

SEQ ID NO: 6456 - protein, 231 aa, Corynebacterium glutamicum
MQAPRLRVGIFDDGSSTVNMAEKLDSVGHYVTVLHAPEDIRDFELVVIDAHGVEGYVEKLSAFARRGQMFLHTSLTHGITVMDPLETSGGIVMSAHPIGQDRWVASALDELGETIVGLLVGELGGSIVEIADDKRAQLAAALTYAGFLSTLQRDASYFLDEFLGDPDVTSDIVMDSAQQFQALPSLDEVIAQYDSINNPGRQRLFRDLARRQAEISRAQDIELWAIQKEDR

SEQ ID NO: 6457 - protein, 266 aa, Corynebacterium glutamicum
MRLRLPNLAKRSARLEFMNQDLSHEDSGDGNSVDRGQILLAVLIGLALIASVIMLLANSDGAMKIALLAALWAAIIGFFLVYRSRKQVEAAAREKETLEYAHQSELNRLEAELVQEKMEISESRRARDQETLEEIKLQLEEMRTQLSELSGREWGYEPTMLRAEARRILELESQQLSQQFQAPQPEVPEPVAVPEPMPEPAPVPEPVPEPEPVEVAVEAEEEPAPGRRRRRHAAPEETGGRRRKDERQGGLSVADLLAAARKKENN

SEQ ID NO: 6458 - protein, 155 aa, Corynebacterium glutamicum
MQKTSAGWLIATGGFLAAVSAILTWRFYGSMTSISITVSITFWLLAVVCGFAGVKVQGRLDEGLIGQDKSQMNPVTIAYLAMLGRACAWGGAIFGGVYVGIGSYVIPRAGELSAASNDLPGVIACALGGIALSAAGLYLERSCEAPPPQSGEAIS

SEQ ID NO: 6459 - protein, 159 aa, Corynebacterium glutamicum
MHAVLSIGSNMDDRYALLNTVIEEFKDEIVAQSAIYSTPPWGIEDQDEFLNAVLVVEVEETPIELLRRGQKLEEAAERVRVRKWGPRTLDVDIVQIIKDGEEILSEDPELTLPHPWAWQRAFVLIPWLEAEPDAVLHGTTIAEHVDNLDPTDIEGVTKI

SEQ ID NO: 6460 - protein, 130 aa, Corynebacterium glutamicum
MADRIELKGLECFGHHGVFDFEKEQGQPFIVDVTCWMDFDAAGASDDLSDTVDYGALALLVAEIVEGPSRDLIETVATESADAVMAKFDALHAVEVTIHKPKAPIPRTFADVAVVARRSRKSMAAGRSNA

SEQ ID NO: 6461 - protein, 279 aa, Corynebacterium glutamicum
MTIPGRCLVMGIVNVTEDSFSDGGKYIDVDQAIAHAKELVAAGADMIDVGGESTRPGAVRVDASVERDRVVPVIKALHDAGIHTSVDTMRASVAQAAAGAGVSMINDVSGGLADPEMFSVMAEAQIPVCLMHWRTLQFGDAAGQADHGGDVVADVHAVLDDLVARATAAGVAENQIVLDPGLGFAKSREDNWRLLQALPEFISGPFPILVGASRKRFLAGVRKDRGLDVTPIDADPATAAVTAVSAHMGAWGVRVHDVPVSRDAVDVAALWRSGGTHHG

SEQ ID NO: 6462 - protein, 196 aa, Corynebacterium glutamicum
MDNHAAVREFDEERATAAIRELLIAVGEDPDREGLLETPARVARAYKETFAGLHEDPTTVLEKTFSEGHEELVLVREIPIYSMCEHHLVPFFGVAHIGYIPGKSGKVTGLSKLARLADMFAKRPQVQERLTSQIADALVEKLDAQAVAVVIEAEHLCMAMRGIRKPGAVTTTSAVRGGFKNNAASRAEVFSLIRGH

SEQ ID NO: 6463 - protein, 305 aa, Corynebacterium glutamicum
MRLESRKGWGGRHLNQGTAQELVPGSEPGSPAQLAVLLHVSGAFQRNRARSNQLEVGCHRIRQLLRPQVPRRQKTQAAPATYPELPIPCDGVRGLRGRPQEWRTSLVVLRHVPVRAPLGFLLVRGFLGEGIVWTRRGRLRRPCVGRCRRKALRGLGVAGFPFPGVFPRGGPGGRGIQPGWSRTLHGLCPGGTGLRCRWLLRLLGSGPSFHRHRVRRMGRPVLGRISPCRQLGTCHIRSPWIGRSWWPFQYRRRRRWWVRRRLVLPRSVHPWQRPGGRTIRCGCTCPCHLLGQSWRDRRCDRGPRW

SEQ ID NO: 6464 - protein, 860 aa, Corynebacterium glutamicum
MSRLPLRMKNKKYLQFGGIAAVILIVLFLVSLFSSDTRNFQEVDTSVAMAQLDAGNVAEAQIDDREQRVRLTLREPITVDEREGVEEILAQYPARTAPAIFEKVEASNTDSYTTNVTQESFLMSMLSFILPMVIIFGLLMFFLTRMQGGGMFGIGGSKAKQLTKDMPTNTFADVAGAEEAVDELHEIKDFLEDPTRYEALGAKIPRGVLLYGPPGTGKTLLARAVAGEAGVPFYSISGSDFVEMFVGVGASRVRDLFKQAKENSPCIIFVDEIDAVGRARGSGMGGGHDEREQTLNQLLVEMDGFGDRQGVILMAATNRPDVLDPALLRPGRFDRQIPVTNPDLRGREQILEVHAKGKPFAPDADIKALAKRTAGMSGADLANVLNEAALLTARVGGNVITADALEEATDRVVGGPRRSGKVISEKEKKVTAYHEGGHTLSAWALEDIERVYKVTILARGRTGGHAMTAQEDDKGMYNRNELFARLVFAMGGRSAEELVFGEPTTGASADIEMATKIARSMVTEYGMSPAVGMVKYGQEQGDPFSGRGGGGNLDHSQEVAATIDTEVQFLLDKAHEVSYSILAEYRDHLDRLAEKLLEKETLRRPDLEALFDDIVPRKVAEVFPDESTRFPRQENREPVKTPVELALERGEEPPKKFSILEASRATRERRRKELEAQGKLPVQPASSAGVAPAAGAAAGSYGTPPPADWSVPGSAGKHRSRAEEQPAEQGFPAQTPAQAPEQSPDSSGGRPNPYATPTASGEHPGMKAYGFGDSELMDQSTGAEHTPGNVSQESPTEMIGFRLPDHERSDYPEKAQKESVLDASETTEMPVVPDQPIDGDSGKSAEGTQENPENEGDNRG

SEQ ID NO: 6465 - protein, 194 aa, Corynebacterium glutamicum
MADHKDLNVPANPYGTDIESVLISEEKLKQRIAEMAKRVSEEFKDAEEDLILVCVLKGAFYFLADFSRMLDIPTQSEFMAVSSYGNSTSSSGVVRILKDLDKEIEGRDVLIVEDIIDSGLTLSWLMRNLKNRNPKSLNVITLLRKPERLTTNIDMFDIGFDIPNEFVVGYGLDFAERYRDLPYVGTLEPHVYSD

SEQ ID NO: 6466 - protein, 297 aa, Corynebacterium glutamicum
MELRKAVRPYLKEHVHIGLSGGPDSLALVAAVLAEKSQVTAICIDHNLQTGSAEVTHNAAAMARHMGAQAIVKSIEVAPGEGMEAAAREARYAAFAQLTDEIWVAHTMDDQAETYLLGGLRGNPAGMKDASRRPELSIIRPLLGARRAHTHGACVELGLKPWHDPQNFDDAFRRVAIRNQVIPLLAQVHGGDPVPGLALAARRAVEDAEVVEGDVEKRRLEWQDGFPVTLAGEPTGLRRRMLADFLRGEGIAVTSRKLDAIDRLLTDWRGQGGVAVGKSDNGRLEVVRQSGKLKITD

SEQ ID NO: 6467 - protein, 411 aa, Corynebacterium glutamicum
MGAVIGGGVWVNHSGFGLDHPEPMSVEMPEQLFSSAIDPDALEAPDFATLEKDLTSQAADSRLGTFVGVARDVESGEVVWEQNQGTAVRPASATKILTAAVALYELGREDTITTKVVEGEQPGTVVIKAGGDVTLSEEMLDDLATQLEGQDIGTVLIDTSIWPDEGFASTWDPVDVDAGYIADVEPAMIEAARIGGSEGDLPRSHTPALDVAQALADRVGADTVDEGSAPDKTVLASVESDTLDQRLARMMKDSDNVMAEGIAKEVAASKDLATDSASTSKMTLEILKDKGFDLSGVSIVDNSGLSFDNLITPRLLDDILTRAATEPELSSLLTSLPIAHGTGTLEDRYDGLSGAGWVRAKTGTLTDTSALAGVVTSESGRVFTFAFVSNGSAIVPAREALDEMASILRDF

SEQ ID NO: 6468 - protein, 158 aa, Corynebacterium glutamicum
MSIEVTVEIPKGSRNKYEIDHETGKVYLDRYLFTPMAYPLDYGYIDHTLGEDGDPLDALVILPESVFPAVVVKSRIIGVFKMTDEAGGDDKLLSVLDDPRYDHIQDISDVSDFLKDEIEHFFVHYKDLEKGKHVDGSGWGDKAEAEKIHAEAIDRYKA

SEQ ID NO: 6469 - protein, 73 aa, Corynebacterium glutamicum
MLNQAGLGPDQWDKESENPTSLSHVPGFAELKSRGHPSQPKRACKKLRTPPKQTGKPESQGCAALNLQKTYAL

SEQ ID NO: 6470 - protein, 513 aa, Corynebacterium glutamicum
MSDLGPIWRWLLLVSVSICAASGLVYELALVSLSTSLNGGGIVETSLIVAGYVAALGLGALLVKPFLNWPAQTFLGVETLLGLIGGCSALVLYFTFATIGQSLWILVIATAAIGILVGAELPLLMTMIQQGRLADAKTTGSLVATLNAADYLGALLGGLAWPFVLLPWLGMMRGAAAAGMINLVAALFVGCVLLRHLLPRTHFFVSVVALLLAIAALATVLVKSDGIVATARAQLYRDPVIYSHQSDYQDIVVTERGKDRRLYLNGGLQYSTRDQHRYTESLVYPSLNPEAESVLIIGGGDGLAARELLRFPSMQITQVELDPEVIEVANTVLRSDNGGAMEDPRVSIIVDDAFTWLRSGGNNGETYDSIIIDLPDPNNDTMARLYSEEFYTLARARLNEQGRMVVQSSSAYTTPDVFWRVGATLKSAGCEQVIPYHVHVPTFGDWGFQLCGPADMELELREDTPPLTFLNDEVLVAAGVFGLDNQPRELEPSTLDHPRVVEDLRKGYRESGD

SEQ ID NO: 6471 - protein, 133 aa, Corynebacterium glutamicum
MLGTLSYFVLAAVILVVGFVILDLITPGKLHELVFVHHLPNAAVITVAQQVSIGIIVVTAVLTSSDILSEGLLETAVFGALGLVIQVVVMAVLEAVIPGRFRDLVEDPKLRSGAVVAAVILIVVGTVNAACLI

SEQ ID NO: 6472 - protein, 137 aa, Corynebacterium glutamicum
MSSRNYRSIGFILLFLAVLCLFAAVFAKPAVGSQVSDRWPGNNGTYSCAGESGVVDEIVNMSTPTDRATDPATGDTYLRYSKNLIIISGEGTPECTITVEGLDRVNSGAFIWLGGGFGPSSPSSSSGGSSGSGGGVK

SEQ ID NO: 6473 - protein, 166 aa, Corynebacterium glutamicum
MIHHIDCMPTDVSAEALGVSWNGESPEVLVDKLIDASPHPSTCHLAVIGGSHVVTVETPDGRFREEISCHAQEAEDSRWPLPDSITRENYLLQTNVAVLSEEDFARAAEEISNGDDDWLIASFPGAGEHHLTALTAEFLEDVWEWFSHHLYPEELTIVSTRSIYKP

SEQ ID NO: 6474 - protein, 203 aa, Corynebacterium glutamicum
MNITWLILAGVLAIIAVVFFYLSAQKKKSEPQPPRQRQDPLKFADGSDTFNARILGPGAIISRGGVDYVCRGAIQFRQGQYIWHEYLLDGGKGSEYLSVEYDEGQLNLGWWITRPDLAQQPAHDVTVEGVRYRKTESGVGTFTSEGTTGVADQGEFEYWDLAEVGGNRLLSFERYGKDSPFEVSLGWTVLPGELTVYPAPEAS

SEQ ID NO: 6475 - protein, 83 aa, Corynebacterium glutamicum
MFLAVILAITAARKFGANVFTSVALAGALLHTQLQAVTVLVDGELQSMTLVAFQKAGNDVTFLGIPVVLQLALHVASLMKLSR

SEQ ID NO: 6476 - protein, 88 aa, Corynebacterium glutamicum
MDIVSSIFAPILGPMAGVGILKGLLAVAAAAHSVDTTSTTYQILYAAGDAFSCSWQSFWRLLRLVNSVPMSLHQSHSLVHCCTHSFRQ

SEQ ID NO: 6477 - protein, 411 aa, Corynebacterium glutamicum
MSTPQSIVIIGGGLAGAKTAEALRVNGYEGSITLIAAEDYLPYERPPLSKEYMAGKVGFDKAIVHPAEWYKENNVTLRQGVRATAIDAGSRQVTVDDGGNTETINYDKLVLATGSAVRKLPIPGADASNVHYLRTVEDSDAIKATFGEGKKLVLIGGGWIGLEVASAARGAGTDVTVLEGGKLPLLKVLGETVAQVFADLHVANGVDLRTEVKITDIVTEDGRAVGVRLDDGEVVPADAVVIGIGVTPVIDLAETAGLEIDNGVLVDAALRTSDPDIYAVGDIANHDHPVLGHRIRVEHWATALNQPAAAVKSLLGKDAEFTNLPYFFTDQFDLGCEYVGHATGSQEKVFIRGNLETREFVAFWVDTENRILAAMNVNVWDVPDQIKPLIASGKSVDTEKLVDPEVPYSEL

SEQ ID NO: 6478 - protein, 96 aa, Corynebacterium glutamicum
MKEVAVNEVPAGAQLIDVRETDEYAEVRAQGAVNIPMSEFVGRIDEIDLDRDIYVICKLGGRSAQVAEYLEQRGIEAINVNGGTDGWVAAGLPTEA

SEQ ID NO: 6479 - protein, 148 aa, Corynebacterium glutamicum
MATHPDIPTELLESPSYQLERLRRRTRDHVEAELAKHETTMREFWTLTCLVHSDAASQSVLCELLAIDASDMVRLVDSLEVRGWAKRERDPKDRRRQIVASTKKGKNAQADLHKVVLEAEDAALDESTSKQLKHLRKLAAAIISTEED

SEQ ID NO: 6480 - protein, 1295 aa, Corynebacterium glutamicum
MALSSVPAQFLRSAQAPPKRTLWDVLESVASTYPEAAAIDDGQVLTYAELMEEVTALADSIHAQGIRRGDRIGIRMPSGTRDLYIAILATLAAGAAYVPVDADDPEERAEMVFGEANINALFDATGFHMLRPTAGGDTRRPRLDDTAWIIFTSGSTGKPKGVAVSHRSAAAFVDAEAQMFLVDHPSGPLGPEDRVLAGLSVAFDASCEEMWLAWGHGACLVPAPRSLVRSGMDLGPWLIRRDISVVSTVPTLAGLWPAEALSQVRLLIVGGEACSQELVERLSTPDREVWNTYGPTEATVVACGTQLYAGQPVGIGLPLAGWDLVVVDDAGEPVGIGEVGELVIGGVGLARYLDPEKDREKYAPLKSVGWTRAYRSGDHVRLEEDGLYFVGRVDDQVKIGGRRIELGEVDANVAALSNVRSSAVVVQTTGADQKVLVAYVSLEDAAAGFDHNVATARLTETMPAALVPRIHVMDDLPVTTSGKVDKKSLPWPLPGTVVEANDLSATEAWIAQEWVDILGTSVSSKDADFFSLGGTSLAAATLVGRVRAKVPTAAVRDLYDHPRLEKFAERVEAIAADTGISLEAPNQVEERVVKPVSFGTRVMQTLIQIPIMTLQAAQWIAWLLLGNNIMAALDFDWAVHVSWWLVIGMILVFATPIGRLPIGGWGARIITRGITPGSYPRGGSTHLRIWSAERLADASGSRNISGATWVNYFARSLGVKMGKGVDLHSLPPITGLLTLGNNVSIEQEVDLRGYWLDGDILRVGTIEVHDNARIGARSTLLPGTVVGTGAHLLPGSTVTGDKTIKPGSRWAGSPAQKVGRAKHRFPTSHPPRRSRWVPVFGATSIVLSLLPLQALAIGAAITLWLATISPLPLIWGVLVFATVGALAAFFAYTVTIWVLVRLIQIGIKGGTAPVRSRLGWQVWAVQRLMDDARTYLFPLYASQLTPLWFRSLGAKIGKDVEISTAVMVPKLADIREGAFLADDTLIGGYELGNGWLLSGETRVGKRSFIGNSGIAGPERKLAKNSLVAVLSSTPKKAKANSNWWGSPPERMRRVTVEVDEGEAKTYSPGFGVKFARGAVETARLLAPITSGVLAALSLLLMQYLLTEFNMWITWLLGGLILMTVGVLAMGITVVMKWVCVGKHKPSEHPLFSRFVWLNELQDAFVESVAGPWFLVPNLGTGALNAGMSALGAHIGRGAWIESYWLPETDLCYIGKGATVGPGVVVQTHLFQDRVMSLDTVTVADGATLADHSVALPASLIDASATIGPGSLVMRGDKVPAHTRWQGNPIEPWSNS

SEQ ID NO: 6481 - protein, 487 aa, Corynebacterium glutamicum
MDLNGAYTQDIAVEPVATKVNFLLDGNIVAQGQKASDWWQGVKIHALAHLHTQGTREVVHPGCARNIARARGISKALGGPNAQVSGTATRVGARSYATGDDAGAPTADRQATNRGSEHQNHADDKPPGDMNSPIEIKRCHDVVAQQQPCNPLCCLQRHDRNLDEGLHHTSAKRNRLDDALLHLVWRLQRNASVGGDSLDTLGEFLQARVIVKITHRSGGNLCTYPANQSRSRERGTAKGEEVGVFAAHRSAEDIDPFLSNPGFRCAEVISFHHGARKRPRQRLLINLAGGGDRQIIHHVNARNQSSRHGFGESGSRDVVIKSSCSIFQRNVCNQNFLIRTSGLNNHCGGTNVGKRCHIGINFTELDASTADFHLIINAAHKVEAIFFQTNVVTGTISAGPTNRLQWRILLAVFFWIKVACKTHTTDDQFADLADSDRFAGIVDNNKIPTSKWQTNAHWLTSIELSATGNHRCFGGAVSVPHLAVRRR

SEQ ID NO: 6482 - protein, 521 aa, Corynebacterium glutamicum
MIKRLPLGPLPKELHQTLLDLTANAQDAAKVEVIAPFTGETLGFVFDGDEQDVEHAFALSRAAQKKWVHTTAVERKKIFLKFHDLVLKNRELLMDIVQLETGKNRASAADEVLDVAITTRFYANNAGKFLNDKKRPGALPIITKNTQQYVPKGVVGQITPWNYPLTLGVSDAVPALLAGNAVVAKPDLATPFSCLIMVHLLIEAGLPRDLMQVVTGPGDIVGGAIAAQCDFLMFTGSTATGRILGRTMGERLVGFSAELGGKNPLIVAKDADLDKVEAELPQACFSNSGQLCVSTERIYVEEDVYEEVIARFSKAAKAMSIGAGFEWKYEMGSLINQAQLDRVSTFVDQAKAAGATVLCGGKSRPDIGPFFYEPTVLADVPEGTPLLTEEVFGPVVFIEKVATLEEAVDKANGTPYGLNASVFGSSETGNLVAGQLEAGGIGINDGYAATWASVSTPLGGMKQSGLGHRHGAEGITKYAEIRNIAEQRWMSMRGPAKMPRKVYSDTVATALKLGKIFKVLP

SEQ ID NO: 6483 - protein, 306 aa, Corynebacterium glutamicum
MVGKLPIMAETNENDLPVIDLAQIEGYVVDDSDEDDPVLLRPDGTPIETWREDFPYEERVTREDYEKVKRSLQIELLKWQNWTKETGQRHIILFEGRDAAGKGGTIKRFNEHLNPRGARTVALEKPSPRESTSWYFQRYIQHFPAAGEIVFFDRSWYNRSGVERVMGFCTESQHAEFLREVPMLENMILGSGISLTKFWFSVTRKEQRTRFAIRQVDPVRQWKLSPMDLASLDRWDDYTRAKEEQFRYTDTDESPWITIKSNDKKRARINAMRYVLSKFDYTDKDYELVGEPDPKVVLRGRDQIGD

SEQ ID NO: 6484 - protein, 54 aa, Corynebacterium glutamicum
MPRLMPIGLEPAATLRRPSRTRACANTVAVVVPSPATSSVFLATSLTSSAPIFS

SEQ ID NO: 6485 - protein, 59 aa, Corynebacterium glutamicum
MVTPSLVMVGAPQAFSKTTLRPFGPKVTLTASARVFSPFSRPRRASSSKAMIFAMCLCS

SEQ ID NO: 6486 - protein, 548 aa, Corynebacterium glutamicum
MAKIIAFDEEARRGLEKGLNTLADAVKVTLGPKGRNVVLEKAWGAPTITNDGVTIAREIELEDPYEKIGAELVKEVAKKTDDVAGDGTTTATVLAQALVREGLRNVAAGSNPMGIKRGIEKAVAQVTEKLLEAAKEVETEEQIAATAGISAADPAIGAQIAKAMYAVGGGKLNKDSVITVEESNTFGVELEVTEGMRFDKGYISGYFATDMERLEAVLEDPYILLVSGKISNIKDLLPLLEKVMQSGKPLLIISEDVEGEALSTLVVNKIRGTFKSVAVKAPGFGDRRKAQLQDIAVLTGGQVISEEVGLSLETADLPLLGQARKVVVTKDDTTIVDGAGSEAQIEGRVNQIRVEIENSDSDYDREKLNERLAKLAGGVAVLKVGAATEVELKERKHRIEDAVRNAKAAVEEGIVAGGGVALLQAAHVLDNDLELSGDEATGVRIVREALTAPLKQIAANAGLEPGVVADKVSQLPQGEGLNAANGEYVDLMAAGINDPVKVTRSALQNAASIAALFLTTEAVVADKPQPAGAAGMPGADEMGGMGGF

SEQ ID NO: 6487 - protein, 60 aa, Corynebacterium glutamicum
MSFQHAEGVRLDAVRAEEEYEAQRQAKRKARNRSAMLWIGTGIAAAVIIVLVMVFIWSRI

SEQ ID NO: 6488 - protein, 403 aa, Corynebacterium glutamicum
MTAPDVYPPSTGLLPTRCPFTFQVLPDPEATSSPFVDATVQDATLPDGWQNSGTLTFAMAGDRSSGKSMYIAVIVKLLRKLVVANGGSFLYADEHTRRIYQEKYEKPLFEQMGLLPPTPPASAPDAHQQRPLIFDISTSNHPEQRLFLVFRDVAGEDLQEENFSAREDELAFFQNADRILFLFDPMSVPRIRQMLEGSVPTHEVDTDGPMVVLRNVLRVLGPDYRPKISLCMSKFDTMQQLAEVNQDHLHYAGANMVNWQRVMSNFGATFRRDSAPLDGAYDRVAGEILDLEIRSMLQCLDATHLLNQFNQPLAGEEAYPFQCFAVSPLGASPEGDRINRSGIAPFRCLDPLRELFSEIGILEGLETSKSNIPPAQPAPTSQPEAQEAPVEEPKKRGFLRWFK

SEQ ID NO: 6489 - protein, 321 aa, Corynebacterium glutamicum
MNVIRLDSNQTYDVPREGFSARLEFDLSEDLGFRVEVPSTETNRRGNTWWIRNPQGNTEVTVFPDGDRGEFPSGTKLYVTVVIQEAGRQETTLQLPTYPIGGLRSIPILNVFPSQGIIRMQAGDVSNDSSLDSEASAVRSALGRTIDKDGSADIARANVTVLVDKTASMKASTSRETFDLMCSFATGVLSVVSQGRSIHVMTSSATDPKVRVANPEEISKLSEKYAPVREVGWNSDLHQISPDDALVVISDDIPAEILKLSNNLHVLSSRKPLVEHGTSTTYFDPVLINAIKNHDQRLLAGPVHQMFNALTSVARREDPTT

SEQ ID NO: 6490 - protein, 662 aa, Corynebacterium glutamicum
MVEAGELPVALRWTHVTYASFRGTAGRGGWKVGTWSAQATKEDLQFIAEVAPTHIETVTPFDDFISSEDIDALPRRFEYRPLAGRSLIMQSVPAGKDATGRPGNVFTHAVFDGDLESPLESVYPISLYRSPDLLTPFRAAAVNAAELPLDAGEPRIGPITDLSLSWMMIDSMFGDRRQQFYQLQDALQAGDKATVLVLNSTNEAAYWLQALSSTLTPNEARRLLHFSTFERAATLPAPDKSMEARSLFVVPGIDRELLAEHSGIVIIDPEIPQSQPFGPQGSWSRMTEGLFSDGFDADELVAGLIRANENLDNSQKELAQFGDGLARFIRNGRFSGTHPLRVLADQHMFGKVPDKPAPKVEPVAPAPNPNAIWARASEVVHNPRRASESQDWPSLRRLPDSRRRIINMSEQAINSIEKLHDSPAQDLVAYLDFLLKTELATSINASDPFFRSSFSDFPAMDNWRHIKFTEDAHPRLRELLVDAERDARNRAPAAIVLDHIVPNFSRDRSLPDIEDWTRSDEAQQIFAGIIAGASVQTGRSHFMWDLLRAYFGVALIGDEDTYRAFTTLTVDSVLSFVQLTLQEGRTEDIRRFEKYGEQIAREDLPSILTNARAVQQYLGYIDQDIINKKVSRSRDVNQIFTEMARAIIRAISRNNIGKDMRS

SEQ ID NO: 6491 - protein, 818 aa, Corynebacterium glutamicum
MASEYQILSAFKTWRDIARIKFNEDQLPTDEELLATAKDPDQLKPGGDYPALLVWATALRRVLGYVQVGTLHVIEQGTDAAMFTPDLDFDKHFEPEDASVDALEDTPVDAEFYDDEPADYHYAEVIDEPEYEPELESEPVHAVPGPAQVPEQVFEQVVAPEPVLDPEPELVPEQEFTPEFTPEPEPAPEPVAEPEPMAEPAPELVRKPAHQAEPSVAEIPETPEPDPTPAPRRRRQNTGSHRSASAEAQSIDRDIRNWQDYEFARLDGFAEVKQAHGGFLRITANLTGGLDLEWDAPESYINASRVFRIVSDEMAFEQDPDLAEHRVSTVGTHWVDQEPLTTAYRMYQVWMYEGVTESSAVNSQPQLVGESVFINPVSNIELSVAGSEVKGQWAPAEHTHRVAVYAAPSNERLVTASRNEIAADKNNFQGFRFHPQHRGREYKFVARRFAEIHGKLVGSAPSEEFVIDVPAEVVEVPISIEERFDGFSTSFDVTWDAPHSGEVWIYRTQEAPESDLQFNAIETDQLESFGLARRDWANDLEDTKTSCNVVWPEDWYSIFLTPVNVVGNQAQVGQTYSRVRVGEISRPKLYERVNNQLLTFGWPEEAHEVTAVFGEPGSGHSVGPTADAPGSSLVSIHREAYEEEGGMRVKLPGAGDVALFASRVYEGRQIWGQPEILKYRGLDKFSYKLHLMNNRLFLSIYSERPNNQFNQFSLRIHPSRLPLEPEDGQEVMTRKIINDGGGQQYADLLAGISSSSLRSEQEPEVEYWEIDPKIASLPPTSYLRLFIHQEESDDVHVKALIDPAPSLLNLGTWIGGSR

SEQ ID NO: 6492 - protein, 933 aa, Corynebacterium glutamicum
MSAAYSQDTILTVFLGRGLTAEGIRQTLEDFAETGLVRNLVWIDADSFHESSSEVTHLATNQDGLPELQRRPFNELVSRSRTTKLHIGVINVIDGSEGMLHAEELNPLVGIIDSVCSHHQIHRSNVMIGAVAATLDEELPILRGYVNLMLAPEDSHSPGTATVTYRHGFSDHRFTLHCVANIASLYGLWEGSTSTPIEQLVPAKGSSFRLVRSFYRRIDGQAVQARLKEKILSTAENPLPRLDIPGKERTAQYAENPDTFAQKAAQEILDEFRTPLIGEEAAAHVEKTKTISGSAVVKQFFSVWIKKMVTTPNRFFAEFSAESKTFAEDALQASVYGNSGSGTRVGDRVTASALSGNKNQRAVQSEDLKIRYAADLQELWQAYANTAMSLLDAQPRAIAYGENGMRTPSVVHTGQSQRVVVARRSADVIPGPETNYGDGLPVEVKVAVDVEEVPPYDLEGVAEFERRLAKESDRGQRGMGQVIGEFKRWQDQNSKSFAYFVGSGLQNLQREMESQEKRWNQEINRLSQQGKSFDGTGLGSRVFRWLGWVSFWSAAIFGVWWAAEYYLAETPMDISRWAVSFAATDTAFKWKFFGIWFGIWLICWIAQCIFETRDEIRFTHLRKDLVTELDAAKKNLKISQQAQLRIQVGYQQFLSVSKIMGALLERPFGNIERARRESPIPINSMPDSVIFAEAIPDSDAVEKLTRQFRRDLYQQGWVSERVMAALNSASDALAAESGNSVNERTLFGSTGEGSYGDLARLSDFVTGEKFRQTDRSVQIWDDITLQLSQESHEVRSGILNSLQIYRGGEKVDAPYQQPLKDLVTVGFFNGEIASEKGRVKGILSLDPSLCMYQPQENESDAIGISEVLLQISEPAEDADISFVRPQQTTFDPTLFDRMPTNEDFRSENPAESPFLDRGNQSHKRPELPGTGEF

SEQ ID NO: 6493 - protein, 1197 aa, Corynebacterium glutamicum
MKKVLVVGCGGSGAKTLAYMMDQLKTTLADSLPERYPNPKEAKLPGAWQFVSVDVPTSPESPGPNLPNVPEAGGRYISCGSSDRYATVDTAVSNQLSSRGALGGVSSWALRNPDSETTPISKGAGQYRSIGRMLILSRLQEIQAELRKSWDVLFSGETERELADLRSALYGTSVSSGETSKEQPIIFVVSSMAGGAGASMALDICRLLTGLEGNAVGLSSLFMVTPDIFSQLSPDQVAGTNPNALAMFAELAAAQMGAASEEDARLFNALGVSVGDDSIPVGRIFPVGIRSGENGALLGDGKPDTVYRALGRGLAALMADEVSMDNFEQFTLGNRGGGSADQSKYAWGAQEAKNIPWGSYGYSQLSMGRDRYAEYAAQRLARSAVDRLLKGHFDPSNDAASDQQLQKRLENNRPSLMGNLSDVLPVNAPAGDWIFHSFNQMIENWTQRMKAIIKSQIPAANGQRGSEWLGDVQRAFQSSSQMIDNDSRHELYMGVADWASADVLQRRVVELLRDEIAKLGVPYGVSVIESLSATIQNQLIGQLSDLANNRAPEAVQLDDVSRSELDNSKGRIDDSDSYIQEIVSRSTGQLHTRAVQYIADHMASVLDDFLKNFIYPLQRTIQREHHSLEKDYQLTNDVNLGISQLKTNVPALWPDESQTTVPSRFSQAANEVFLTDVASFPEQFQAHVRSSTDDINEQNDYSSALQEASTRVVSGVWESKSGSEKAPRDLIRLIDVWVARDLTRDPSGSGSLRDPKQARFELKIDTGEVLERSRQYIRRPGFSFQQFIASSLREFITAPGLADHERRARRQQVLSKFSEAMTYALPLAQINPQLVRALYGDEVRYNFNFSRIPFAGDELGSSLEQAVRDYPNHRPADISKPLGKALVSQGEERSIDIFGSYPNYAPIVFDSLLPPIEKQWRQITGDRTEFWHGRRTRPLTAALPMTDLERNAMVKGWYIGRLVGRVFFPATLDTADTTPVQIYDEKSDSWINFSTPMLTPVSRFRGSLDWLPNLLESASLAWARAGERPVFESVEPYIQLRQLWDDAASPSLPGRTTRGEKLLHDWLFDGNRMAGNVLQIPGTEAGVTPAARFEAAKNFLQRQNEISQNYVPSDKLRQGRLFTTADRPFGDVKDRELAAQIPVFADLAADVFDGTQEIIDILEKCLAAGPPSAQVFDMNVARRDVSSGPSLPGEGEF

SEQ ID NO: 6494 - protein, 925 aa, Corynebacterium glutamicum
MEESALYCDSRPIGVCCCVVGLGYCPVGRKAVMVNTLNSKTVNVPRFARGVVAAATALFFGALVSLAPSALAQEPPAVEAGASGSLSNLGACIADKGTLDVIIMIDETESLIHEARDGVVNANEPGADAQHHRVPAAQSFVDELLAKQSDGDLNTRIRVAGFGQTYKSGATDPDNYGAWTQLDASTVGGVQDEISRFADRTQEQYTNYASAIEGAYQDFTRSGSEDACRMLVTFTDGALTAQEGADVAEAALCAPGGVTDRLRSAGITHIGIGLSAPTNPSDFSLLRGTTAGGGTCGVEPANGAFFPADNVGGLFAAFREALAIGGETIGETRAGDPFSFTLDNSVNSVRFTAIAKDDLGPNAHLVLTAPNGETVELKDSGSSVANSTDVSWEAESSPVKMADGSLNLQQGGDWKGVWQIQFQGIDPAAVDGRVFNSVEIQPDLQLVFSGGDSTSGALNLRDDQQLNMQLVGRDGQPRILEGSALVDLGFTRADTGEFAPLAQGIDISGGELSFPLDTISQLPAIGTVEARTTITTAGVDDLPGTTLSPILNTTRITITQRDMPQLPASVRFTADEDVVTVDIPITGPGKVWIAPGTQLSGVLPDGVDGIAASSTFDSPDNALVLGLDEQGTIPVELTVSDLRDGLVNGSIPLQISNAEGANETSVDLPTEGTLSVPINASTFALAFILALVLSLLIPLLILYIVRFLSAKVPSSAMSGVRIPVEFSGEALRYAGSTMPDLASQTTATKQVVVHGDTFNVEGHKLKVQRFQLNPIASPAVIVQTDPSISFDGKQKGTQAKLPLAVQGSWFLTASGADPSKMELIALTNLPLEQGQIDRMIAGITSKAPDRARELQKLLDDAATSQPAKVPPRAPAAQGHVEKQAPSFGTGSGGGFGSSNGGGFGSGSGSNDTNGGFGSSGGFGAR

SEQ ID NO: 6495 - protein, 204 aa, Corynebacterium glutamicum
MSQGFTQPPGGTFGSSSGGFSGGQSGFGGGSQNSGFGGSSGGFSGGSSNGSFGGSTGGFTPAGATSNPSGFSTPKVAESPAPGRSSGRKRAGGRLQSAPTEWILPGLVLGLISLGLNAWITFGAPVATDNLFLIVAGIAWVLAGILSVLSIGKYMSAVNERKSTGFYTEVPWKKALFTATAVLLVFAVVWSALDIALWVGKQSW

SEQ ID NO: 6496 - protein, 457 aa, Corynebacterium glutamicum
MTQFENAQVLKENIENQREQIFTQLKEIVSFNSVHSDPNLLEDYAGAKEWVKETLTNAGLTVSEFAAEDGTTNFIGTRKGSEGAPKVLLYSHFDVVPSGPLDLWDTNPFELTERDAGHGTRWYGRGAADCKGNLVMHLAALRAVEASGDTTLNLTYVVEGSEEMGGGALSALIKDKPELFDADVILIADSGNASVGTPTLTTTLRGGGQVTVTVDTLEGAVHSGQYGGAAPDAVAALVRVLDTLRDEHGRTVIDGVNTTANWKGEPYDPETFRSDAGILDGVDIMGDGDNPASMLWSRPAISITGFTSTPVAEALNAVPATASAKLNLRVPAGLEANDVAEKLKQHLINHTPWGAKITVEIDDINQPFSTDITGPAMSTLASCLSAAYEGKDLVTEGSGGSIPLCTELIEVNPEAELALYGVEEPLTVIHSANESVDPNEIRDIATAEALFLLNYTK

SEQ ID NO: 6497 - protein, 193 aa, Corynebacterium glutamicum
MTQRTVSMSLYTRTQNTRHSTIIEFRREQTRNHTMEPIQSEPRIYADDPFRARFGHQLPRGLREEARGMEWRTFTNTYAPTGNLRISNLESEARRGGMFHFNATLINNCQGERTTTDAHIMATGPVSACTNLLADAGRRVEILEFHQFDIFEATVTFIYTCNNVSRTWAMGFGGTPEQSAASAMSSAAHLLYG

SEQ ID NO: 6498 - protein, 200 aa, Corynebacterium glutamicum
MPSRLPGNECYCNLSVEQVSCGAHCGSSGLLRGTAEAHCPGAGNVVAGVDEGDGCFKDVELVEFEDFNATAGVGKQVGACGNWAGCHDVSVGGGALALAVVDQGCVEVEHSSAACLGLEVADAQVAGWCVGVGEGAPFHAACFFAKSAGELVSEACTERIVSVDPWLGLDWLHRVITSLLAAELDDGGVTGILSTGVERH

SEQ ID NO: 6499 - protein, 1019 aa, Corynebacterium glutamicum
MLILFLALTAAAVVAPILIRTLGRPAFGLLALVPGIGFFWVLSEFIKGTFKDGGELLLHYAWMPSAHLNIDFRMDSLAALFSLIVLGVGALVLLYCWGYFDSNAGRLSAFGAELVAFAMAMFGLVISDNILLMYVFWEITSVLSFLLVGYYGERASSRRSAGQALMVTTLGGLAMLVGIILMGTQTGVWRFSEIPAYSSSWADVPYISAAAALILAGALSKSAIAPTHFWLPGAMAAPTPVSAYLHSAAMVKAGIYLVARLSPDLNVVGSWYLIIIPLGMLTMLMGGWMALRQKDLKLILAYGTVSQLGFIISVVGIGTREALLAGLALTVAHSLFKATLFMTVGAIDHTTGTRDIRKLSGLWRKQPILFAVAAVSAASMAGIPPLFGFIAKETALDTVLNEQMLHGMPGRLMLAGIVLGSIFTMAYSCYFLYEAFATKHSKFPEANGVSPAVEAMHPVKFKLWIAPVILAILTVVFGVFPKPVSEAIVTHLDNVTPSLDDVHTKLALWHGLNLPLLLSVVIIISGFIIFWERDTVERLRPNTAAFGSADTAYDAILDALRVLSHRLTASTQRGSLTLNVGVIFFVLTIVPLIALITGEQSDVRMELWDSPIQGFIAAIIIVVAIVATTMDNRLSALILVGVTGYGIAVIFALHGAPDLALTQVLVETIVMVVFMLVLRKMPTEVAWKAEPKQSRVRAWLAGATGLSVVIVTIFAMNARTTEPISVYMQDLAYEIGHGANTVNVLLVDLRGFDTFGEISVLVIAATGIASLVYRNRSFRKDSRRPTLATTGRRWLAAAVDTERAQNRSLMVDVATRILFPAMIMLSVYFFFAGHNAPGGGFAGGLVASLAFALRYLAGGREELEEALPIDAGRILGTGLFVSATAVLWPMVLLGEPPLTSHIWDLTLPLIGEIHIASALLFDLGVYLIVIGLTMHILNSLGGQLDRDEEMRKQRARDRARRLARNQRREAATVGARRSNEKSTRQMPTIRPPGADTESVEQNGENQTSISTKRLKQEGK

SEQ ID NO: 6500 - protein, 163 aa, Corynebacterium glutamicum
MVANLFLLLAAGTLISAGVYLLLDRAMTKMIMGLMLIGNGANLLILVAGGSAGSPPILGRESEIYGDKTADPLAQAMILTAIVISMALTAFMLSLAYRQYRYRTEDFIEDDTEDVAITVRPSFASAAPDHDASDDPETGRMTSDGDDFGPESFEAPLKGDKDD

SEQ ID NO: 6501 - protein, 556 aa, Corynebacterium glutamicum
MIPYMVPLPIILPAVAAALALILSKYLTAQRTITLSVLAFLIGLNATMLYVVDREGIQTLQLGGWDAPIGITLVADRLSVSMLTVSSIVLFSVMWYAISQGIRDGGKDEPVAVFLPTYLLLSMGVNLAFLAGDLFNLYVGFEVLLVASYVLLTLGASPARVRSGVGYVMVSMASSMVFLFGLAMVYASVGTLNMAHVGLRMEDVPSGTRSAIFAVLLVAFGIKAAVFPLDSWLPDSYPTAPSLVTAVFAGLLTKVGVYSIIRARSIIFTDGSLDTMLMWVALATMLIGILGAMAQNDIKRLLSFTLVSHIGYMIFGVALGSAQGLSGAIFYAIHHILVQTSLFLVVGLVERQAGSSSLRRLGSLAYISPLLAILYFIPAINLGGIPPFSGFLGKIMLIEAGAEDGSWLAWVLIAGAVVTSLLTLYTMVLVWSKAFWRDRKDAPDGATALARPAPLVDIQDEVAVKDRNDVGRMPWGMVFSTALLVSASLAVSVLAGPLSSITGRAAESAQDVNIYRAAVLGPNYLDPSRTLEMERYDANRDDINHRVDTNGTEDQP

SEQ ID NO: 6502 - protein, 147 aa, Corynebacterium glutamicum
MLMAEFTWANFVGGFLVASAIVLFLPLPAMPIENISIRWGSLILLILNWFKDLAVASVKVAWLALRPADPPRTAIVQVPMRVQNDLVLSFATMLYNLQPGGTVTDIDIANRMWTIHVLDADDEEDLRREIQNVADLEATLIHTFERS

SEQ ID NO: 6503 - protein, 91 aa, Corynebacterium glutamicum
MDNTLYTAGLTIAAAFFMLSFIFTIYRIIVGPNSIDRLLGLDGTVSMIQCSMATYICWTLDTTVTNFMMVIALLGFISSVSVARFRKRDGA

SEQ ID NO: 6504 - protein, 126 aa, Corynebacterium glutamicum
MTLQLFTDIVSLVFILSGAFLSFSASIGLIRFKDTMSRVHAMTKPQTTGLILTVVGAIIRILGHEHFDQSQRSDLGVLVLLVLFALLTSPVTAQRVGRVSRREGLYGAKDDMSDNQAPAELKPKKS

SEQ ID NO: 6505 - protein, 198 aa, Corynebacterium glutamicum
MESQHIIFIPESQQTPDEFTEVVNEIPAGIKPRIVPWSGSVSAGVQAVESILDREEIRRVILVGAGTGAGVALEIAKNQPRRVERLVLDSPLVTFDEKQLKGMSTALKMMPGFFFRKKNKKDLLQQVEEARTAVPMGFSEITMPTLIIRGSAAKAGIDSDLEKQIPSARATTIIGANWLTYTTHGRQTGAAIAEFLAQ

SEQ ID NO: 6506 - protein, 376 aa, Corynebacterium glutamicum
MGIEFKRSPRPTLGVEWEIALVDPETRDLAPRAAEILEIVAKNHPEVHLEREFLQNTVELVTGVCDTVPEAVAELSHDLDALKEAADSLGLRLWTSGSHPFSDFRENPVSEKGSYDEIIARTQYWGNQMLIWGIHVHVGISHEDRVWPIINALLTNYPHLLALSASSPAWDGLDTGYASNRTMLYQQLPTAGLPYQFQSWDEWCSYMADQDKSGVINHTGSMHFDIRPASKWGTIEVRVADSTSNLRELSAIVALTHCLVVHYDRMIDAGEELPSLQQWHVSENKWRAARYGLDAEIIISRDTDEAMVQDELRRLVAQLMPLANELGCARELELVLEILERGGGYERQRRVFKETGSWKAAVDLACDELNDLKALD

SEQ ID NO: 6507 - protein, 221 aa, Corynebacterium glutamicum
MTSDMQNSPQHSATPSEEKQGGLPMRGLAMILIAVAVLLAAWALWSMQGKDDTSTTSAGQTQSTETNAGTIAESSGSSDSEQASAEPGTSEETSAEQPAADGEAANAAGAAAAGGASSANGNSTPVNTLYVLNNSTVPQLAARVADSLSGDYQKVESGNLPDTIIPQNTVYFTAGNTEAEKAARELADRVSGVAMERSDALPTETEGKDALVLVLVQDVAL

SEQ ID NO: 6508 - protein, 193 aa, Corynebacterium glutamicum
MTVRPIVIHGDPVLHNPTQLVTEDVSELQELIADMYETMDVANGVGLAANQIGVSKRIFVYDCPDDEGVMHKGCFINPVLETSEIPETMPADDGSDEEGCLSVPGEGFPTGRAHWAKVTGLNEKGEEVSVEAEGFLARCFQHEVGHLDGFLYTDVLIGRWKRMAKKAIKANGWTEPGLTWMPGEDEDPFGHDA

SEQ ID NO: 6509 - protein, 84 aa, Corynebacterium glutamicum
MNNDWSDSHGNILSMLSADDLTLLEFEAHAPHAIGAKEEAIRATFGISPVRYYQRLNVIIDTPEAMKVNPTLVSRLRRRAGKID

SEQ ID NO: 6510 - protein, 335 aa, Corynebacterium glutamicum
MTPSLPRFRSQKPAVGDRVVARRRIPGANVHWTDVIGHVIGVDPLVVRPQSVGGMPSDAEEIVIPDDQLEVIKILSPRTIRNSDIRAVEVATAKAFPGLVNEWHDGWLLRAGDGIAERSNSASPLGPSVGFEPVPMEDISRFYARHDLPVKLHIPERIGRPAQKVIDADPQKWVMGPEILVMTKSLDHVESHELPGGLEFSVDKQPDQEWLGMYHFRGQALPAHALELLRTQIEGRMGFGRLTTPAGQTVAITRATITAAEERIFLGYSAVEVDPAFRRQGLGTALGSRIQEWGAEQHAQEAYLQVVAHNEAGIGLYQKLGFSEHHRHRYAERKF

SEQ ID NO: 6511 - protein, 223 aa, Corynebacterium glutamicum
MTISSASDGIPPTDCGRTTNGSTPITWPMTSVQCTLAPGIRRRATTRSPTAGFWLRKRGRLGVMPERILIFTRHPGQTRLSPPIGLNSLLSHALPPTNQHIGVQETIKVANLMLEATSQETLSLNRNFLALFIQSSNLRPMSTASGEALARNRQAAFLVGAIIGRHGLWDFRGFQHRIDETTLVHHALIIRTVINKNALGHTNLVGRKTHTIGDIHRLVHICN

SEQ ID NO: 6512 - protein, 210 aa, Corynebacterium glutamicum
MVQRFRHHQNLRAHHPFLGIGVNDFLRRPTNPLRNVQLHGEIVTCIKPRNILHRYRLKTDTWAEWRRRIRTLRNAITGTQQPTIMPLIDQPRKGLRRGNLHRTNIRIPNGARRQNLNHLKLIIRNDNFFRIRRHPTNRLRANHQRIHPNHMANDICPMHIGTRNPATCNNTIADGRFLAAETGKTRRHARKDPHLHPASRSNQAQSTHWP

SEQ ID NO: 6513 - protein, 263 aa, Corynebacterium glutamicum
MRIVNWNVNSARTRVDRMVDFLLRHDVDVLAVQETKCKDEQFPTERFTEIGYEVAHFGLNQWNGVAIISRVGIENVETHFPAQPGFNKDITKEQSIEARAIGARCGGVQVWSLYVPNGREIADPHYDYKLRWLFSLRNYVIDTLEYRPEEKLVLLGDFNIAPTDIDVWDIAAFEGKTHVTEPERAAFDGLIEAGLKETTPGPGTYTYWDYKGARFLKGEGMRIDFQLASPALAATAGETFVDVEERSGTGASDHAPVIVDYKV

SEQ ID NO: 6514 - protein, 500 aa, Corynebacterium glutamicum
MIFQINLESWQTVGLIIDYTIKIIAIGYVPEGRRPSSSTAWLLAILLLPYVGLPLFLLMGSPYINRRRHRIQQEINDLIEDVHDDVPDIPTGMDVSAEVESVIKLNRRLTRMPAVTGGNNGFYSDYRESLKRMTAAIDEAEEYIYVEIYIMAWDSYTQPFFAALERAHNRGVKVRLLFDHVGSWKYPGYHRLKKELNRMGFAWYLMLPLQPWRRRFRRPDLRNHRKMLIIDGHTAFMGSQNLIAPSYLQKKNIKLGREWKDLMVELTGPIVSSMEMIFAGDWYVESNEALDIRDHAEAHGYIGNTQKDSATNLVQLIPSGPGYTTEPNLRMFNSIVHHAKERLILCSPYFIPDESLLEAVTSACYRGVTVELFVSEQADQFAIDHAQSSYYQALLEAGVKIYQFPKPDVLHTKYMIADPDDTTGNEALGVLGSSNLDIRSFGLNYEISLMIAKGNLIHELNALTDRYRTVSFKLTLDKWNQRSWRRRYVDNVMRLTSALQ

SEQ ID NO: 6515 - protein, 218 aa, Corynebacterium glutamicum
MGNDKKQQQQEQRYPINKQHFNQQKRTQHSKTGQHSLHDAVWMNPLQKSPIDHSAHNQTKSIHSENNGIQQYRNAHLILQHERRRRNVGEHRPKRQPQCEYICQKLRILQHKDIVGQHSAKSCCGTLFNWLRLLNLQQSNKQLRKIHQCKCPENSPPAKRPDQHTTNERSYHGSNSLNNHQQCKGVRSLLSAFKVWHDRARNHHARTAAKPLHQACDH

SEQ ID NO: 6516 - protein, 398 aa, Corynebacterium glutamicum
MQKKQQLSTALIMGLALLSASSALATDMYLPAMPGIAEDLGTTAPMVQLTLSSFMAGMAIGQLIIGPLSDQLGRKGLLVAGAVAALVASVVCALAPSISVLVIARLVQGLGGGACVVIARAIVPDLERGQKAAHAFALLMIIQGIAPVVAPLIGGVLVGPFGWRGIFWALALVNFAQLLVALLQIKESKPVEERTAAGLGGMLSNYVFVLKNPQFLAYVFTLGLSFGAMFSYISASPFVLQNQMGIPVLLYSIIFGVNAFGLIVGGMVNRRLLQRIHPHRIMQTVLASFTVLCALLLIEVLFINWIPLFLLLLFLIVSHIPMVMANATALGTEVVRSRAGSGSAILGFVQFTMGALVSSLVGLGSDKALTMGIAMTACALLACGCAYLAGRKGIPEMK

SEQ ID NO: 6517 - protein, 388 aa, Corynebacterium glutamicum
MLLSGWGKFVRWLLVLLSILVIIIGINLILDGVYGFGTFSTTQMYQVAKDPLIGVLIGILATALVQSSTTTTTLTVTAVGTGIVSVPVAIPIILGANIGTTITAMLVAFSYVGERREFKRAFTVAAMHVWFNVLVILVLFVVELLFHPFRTISGAIATEITLTTGGSLPTSGVMTKIFDPPTQLLGMNGLIGSIGNPSISAIVCLVVGTILILISVRAMSSQIRTITAATVTSIMDKVINPENSPKATILSNFWSFILGVLFTLMVTASSVTVASMQPVAASGVVKQKPLLGVILGANVGTTVTAMFATFAIVSDQGEFAIQAALIHLIVNFTGALLVLCIPQLANVIIHLAEKTANLTARSYSITLATIVTAYVLVPSAVLMIYFFI

SEQ ID NO: 6518 - protein, 280 aa, Corynebacterium glutamicum
MPSKISRPYYQVDVFSSEPFMGNPLAVIADADDLSAEQMARIARWTNLSETTFLLKPTQEGADYRVRIFTPTGELPFAGHPTLGTAHVFRELHGEQGTQLVQECVAGLVAVRAIDGPASGLAFQAPPTLKDGPLDASDLDAACEALGISPDFIRAHQWVDNGPGWAVVELPSAQHVLDLEPDFSAHPTLKLGVIGAYPEGAPHAFEVRAFAQGIGEDPVTGSLNASIAQWLHRDGRAGEGYLASQGTAIGRAGEIHISIESHAIWVGGSVTTIFQGTAEF

SEQ ID NO: 6519 - protein, 211 aa, Corynebacterium glutamicum
MDQTCHHQILLVDNRTNSGLQPGIRSAHRITRHRRKLCITVPSRRQHSHRPLPPWLRGDHDPIHHDVHHRISIRLPNPNLPRHTKTLGCRRFQMVAVPRVRRSVDLHHRDSVLLSSQSPGIRHCKLHPGGVGRYASTTNHVAIPTGSSTIGNFLFRNCAPAASNCRSSGTGAYVALRYRKPPVFLATHRRIRRQVWSLHQPLRIHHRLSIN

SEQ ID NO: 6520 - protein, 256 aa, Corynebacterium glutamicum
MWTTMINTIRSEWTKLVTTKSFWWTTALILVFSLGYAALTGSLATGESFASLFLLAGSTVTGLYLLGFVVIMIQSIMMFTTEFRFGYQTQTFLATPKRWVVAVSKWLLYLVFAVVLTFITVILCFYLAKALASDTASSTLVVWEDTQARRIMWQYPLAAALLVTFCSGIALLLRQTAGAVALVLMWHFAIENLLSFLPRIGEYVGKYGPFTNLYAFITDYQSIDPGWSTTMGAVYFGAWAFVLFALGIVVLEKKDA

SEQ ID NO: 6521 - protein, 312 aa, Corynebacterium glutamicum
MRMINVEGLTKQYGQVRAVDDLSFEVKPGIVTGFLGPNGAGKSTTMRLILGLDNPTAGHATIEGQPYRSLKNPLTKVGALLDAKATHPNRTAENHLKWIARANGLSTKRVDEVLTLVGLTGVASKKTGGFSLGMGQRLGLAAALLGDPEYLILDEPVNGLDPEGIHWVRTLLQNIAKQGRTVLVSSHLLSEMAQTAEHLIVIGRGKLVADMPMHEFVRSHSASTVVVRAAVPGALENALKEAGVAFNTAPDESGRMTYRIDGSTTDDIGRLAFERGIALLELSETRASLEEAFLETTGEAVQYQAGSVDNND

SEQ ID NO: 6522 - protein, 167 aa, Corynebacterium glutamicum
MDTMKGDGDGWAAAPNGGAVWGKNGAAGLLLVADKQMLMQHRAAWTNNGDTWALPGGARDSHETAAESALREAFEETGILPDDVEVLDSIVTAGPFPADPERPELAGNWTYTTVIARTKTGETLDTTANEESLELRWVDIAAVDSLALMPAFAKAWPSLRKLLNTTE

SEQ ID NO: 6523 - protein, 462 aa, Corynebacterium glutamicum
MDTDDSPDHWLDPLTEKDTSKRTLVNSIVQETFGQPIFVARKIWAFVNTSPGRMTLMTIIISIAIFAAGYAMSVSSDTRQSNLDDLITNAEPVSYNAHVLYTSLSVADTTATTGFVQAGVEGPVNRVKYHTAIDRAAVAATHTAASADSSNEHLMELVLEIQRQLPVYTGLVETARTNNRAGNPVGVAYMSEASAMMRNEILPMASELYNLTSRAVSDQQRSVTGPQWFPLSGLLAALAMLIVAQWWLMRITRRRINKGFALATVMMMTATLWVSAANWATWQAGTKGFEEASGPLNSMTTARIYAQQTRTTETLSLVRRQSIQGSGTGFTATINQIKRALDEYETTAQSQTPEHQQLITAIRNAIAAWTADHDEFTVLLASGDYNGAVNAVLNKDEEGQTSFDELDTALAELIADSRSSMRSYIQSGLQATELVSVMVMILSVVSVLALWVGIRPRLQEYL

SEQ ID NO: 6524 - protein, 344 aa, Corynebacterium glutamicum
MHAFRRPPPLTTRVGAALLAATLLASCTPTPVEPAETLTALDPDAGPPLPPDSSIEAPGEKEPIVEVIENWPGSLRPDDLTPEERVPGIVNRGRIIVGVDQSQNLLSFRDPVTGELRGFEVELAREISRDIFGDPNKVDFRFVGSSDRLRSLDQGDVDIVIRSVTITDERAKLVEFSTPYLRTQTRMLTMESSGITSIADLPGHTICVTDGSTSLQRARTIAPEASILKTRNWSDCLMALQQHQAQVILGDDVILSGIAAQDPYTEILDTSLDSHSYGVAAASTTAETDSSGLIRQVNYTIERIRTDRMWWTMFDDWFGPYLWSYGPPQLQYMPEEEGTENDEG

SEQ ID NO: 6525 - protein, 751 aa, Corynebacterium glutamicum
MVVEQPAVEDSLGSASAHTETTAASLRPRPEVDPSERSRRQAISLFRERRRVRRQSRPVADGMVELPFITPKPEDELLIDPEKKRKPGVAAPQLVAGDIVAEQYEVLGVIAHGGMGWIYLANDRNVSGRIVVLKGMMAQSSVQDQGTAEAEREFLADITHPGIVKAYNFIDDPRVPGGFIVMEYVNGPSLKDRCKAQPDGVLRVDLAIGYILELLPAMDYLHQRGVVYNDLKPENVIATEDQVKLIDLGAVTGIGAFGYIYGTKGFQAPEVATHGPSISSDIFTIGRTLAALTMPLPVEDGVLAPGIPSPKNSPLLRRHLSFYRLLQRATADDPQHRFRNVSELRTQLYGVLREILAVRDGKQYPPQHSLFSPQRSTFGTKHLVFRTDRIIDGIERQARITAPEIVSALPVPLIDRTDPGARMLSGSSYAEPSETLETLRNSMEDEQYRQSIEIPLGVVRALLDLGFTTEARQWLETLEGRIGDDWRHKWFSGITYLLLDDYATAQVFFNHVLTILPGEAAPKLALAAVDELILQQIGAESTAYLTPDIVSATATLSKDFEDLDASAFESLSDTWSHISSDPHVVRFHSLRLYALVWATNPTTVSSAFGLARQLMAENQIELAVQALDKLPQSSTHYRMATLTTILLLVSSNLSESRIRRAARRLTEIPTNEPRFNQIKIAIMSAGLSWLRERKLKASASANPLFEYPFSQKGLRTGISEALRIQARSAPFPHHRYALVDMANAVRPLSWF

SEQ ID NO: 6526 - protein, 249 aa, Corynebacterium glutamicum
MGGYFGCLESFGAVNVAECADAGNRAEVDEFNLVFGGDDVFGFEVVVHYAALVQVVHGGEEFEDVADGEVDAEHAVGLGFAAVFQGGAVDVFHDDESAGDAGVVDEVVGLHDAGVGDVGEEFAFGFSGALVLNGRLRHHAFEHHDAAGHIAVVGEVNPTHAAVRDDAEDFILLCDDIARDKLRRCHTRFALLFRVDEQLIFRFGGDERQFHHAISNWAGLAPYAAPFAEQRNCLSTTPLTWIHLWAGTQ

SEQ ID NO: 6527 - protein, 455 aa, Corynebacterium glutamicum
MSRPLRVAVVGAGPAGIYASDLLMKSDTDVQIDLFERMPAPFGLIRYGVAPDHPRIKGIVKSLHNVMDKEQLRFLGNIEVGKDITVEELREFYDAIVFSTGATGDQDLRVPGSDLEGSWGAGEFVGFYDGNPNFERNWDLSAEKVAVVGVGNVALDVARILAKTGDELLVTEIPDNVYESLAKNQAKEVHVFGRRGPAQAKFTPLELKELDHSDTIEVIVNPEDIDYDAASEQARRDSKSQDLVCQTLESYAMRDPKGAPHKLFIHFFESPVEILGEDGKVVGLKTERTQLDGNGGVTGTGEFKTWDMQSVYRAVGYRSDAIEGVPFDDERAVVPNDGGHIIDPEVGSPITGLYATGWIKRGPIGLIGNTKSDAKETTEMLLADHAAGSLPAPAKPELESIIEFLDERKVAFTTWDGWHLLDAAERALGEPEGRERKKIVEWNDMVRHARPEYDI

SEQ ID NO: 6528 - protein, 182 aa, Corynebacterium glutamicum
MTRYFAVSNLQELGSLEVHKLYKLRVDIFVHEQQTPYAEIDDTDAAPTTNHILVWERADATPTNLIGCARLAPITAAELKAYTGKGISLDDATPLSQLGRVAVAQEGRGSGLSGELMRNALRLAYEQYPDRDVVLTAQKPLVDFYAEYGFEVLGEEYLDSGVPHLPMLLKADELERFSDLDA

SEQ ID NO: 6529 - protein, 354 aa, Corynebacterium glutamicum
MGKHTRFWSRHTLILGALMKTKWLAIIPFVALAVVACSDTQPPVTETVTETAPQPTSETAAQPPQPTTPAETTTQQAEGINLTPRYTRQNVGHFSSGYQPGQVSFSSADGTIKCEFRPMEQDAPINREPSTDWRLSFVQGACQFDDGYVVADTNVENRPGFAEYTTAISHVMPENYTTLPPGTYIDLHTMACFTESADEISCIKYATNETFRISAQGFEMLSNAQRDAELTTQGGLYQAFSNIAELRFSDGNAMSCFFDAPGSQDFWCQTLSTPGWDDGSNLIHLTVTGGKLSLMGTQVGNPGLDYFRGRQLIEAPNSLLDASLSVTLDGDRVRFRTATGEEMWVSSSDYGLGV

SEQ ID NO: 6530 - protein, 343 aa, Corynebacterium glutamicum
MARTTTAHAVLMALSSVGLLMLQACSEQEQTPEQTPAPTLTSQAPETPQASTTSSASSTATPIATPIAATELDYLHIDPATYDIGVQDQETAVFTTGDGITAQCFFEATPGETSYQIKEFDFDETAGTCAFGDQHISVTTDENVRERFAELSETEEELPEAQATLDVGEMVHLGHMGCWAPSVSEFSCLDFASNQAFTMNEQGFHELDPAKATEQLINSSGQVQTLSKMTNFQFTDGTSITCVSELQAEEFLCHNSGPGGWSTSAGPANTLWWNLNQADSEFEGARPTNPTQSVYKSQQIFGPGSYLLANGVSAEFDGTTLTLTTPQGNQYWANTHDFGAGTH

SEQ ID NO: 6531 - protein, 133 aa, Corynebacterium glutamicum
MLGKHRGSISWVSTILLAIGVILIGYAAVAVGPQLDSGGAAGWWALGIGVVFAVVSLCLYIIGISLRHTTTSEVVASGAIAALFFISYLVWTTPVSDPVIFHPALINFGCAVLWLVITIFCAFRRGSRVGIKI

SEQ ID NO: 6532 - protein, 398 aa, Corynebacterium glutamicum
MTPNATKVMLLGSGELGKEVAIAFQRLGLEVHAVDRYEHAPAHQVAHFSYVIDMTDAAQVRELVERVRPDFVIPEIEALATDELVKIEEEGLATIVPTARAAKLTMNREGIRKLAAEELGLPTSNYEFCSTFEEFSAAAEKLGYPNVVKPVMSSSGKGQSVLRSSDDLQAAWDYAMSGARVANSRVIVEAFVEFDYEITLLTVRSIDPTTSKPATWFCEPIGHRQEDGDYVESWQPMEMTPRALENARSVAARITNALGGRGVFGVELFVSGDDVYFSEVSPRPHDTGLVTLATQRFSEFELHAKAILGLPVDVTLISPGASAVIYGGIESEGVSYTGLAEALAVAETDLRIFAKPEAFTKRRMGVAVSTAEDVAAARDRATLAAAAIKVHPGNSAEA

SEQ ID NO: 6533 - protein, 296 aa, Corynebacterium glutamicum
MYTFCTLKIWALFGNFRLEKLFVVFVSYIQIVLLPKLERFNMKLSKATRCLVALMFAAPLMSAPLANAVDNTWFNGVVTPGTTMYEGAGSWGFLRTSSNASSGLTDNPLVVMTCRLGIYSSVGGDTCSVSTSQLNNERASFTYEYRLGGQEAPARAWIGGIPSGGMSIADSQDEIFSIASESTRWTDGSWSLQEVHSSAGDVQLKIVSPEVQAVTNVSAEAFESRGGSISLNDGTKELSFLVFPESSEKPNEIIENSNSHNIEMVSAGVFQRITQGNEILEIQTGSGLALETSLVY

SEQ ID NO: 6534 - protein, 298 aa, Corynebacterium glutamicum
MSCFRFVDDVRKTYPVKRLCEVLKINRSSYYKWKKTAPTRSNRLLSDAVLGAKIKSIFTKERGCYGSKRITAELNDDPGSTPVNHKRVARIMASLKLFGFTKKRRVITTVSDKKKPVFPDLVKRHFNALAANEVYVGDITYLPIADGTNMYLATVIDCYSRRLVGFAIADHMRTSLVQEALLMAKSQRGSLKGAVFHSDHGSVYTSQAFQDTCKKLGVRQSMGAVGTSADNSLAESFNAALKREVLQDSKTFANQLVCRREVFRWCTRYSTNRRHSWCGYVVPAVFESRNLAILKSVS

SEQ ID NO: 6535 - protein, 89 aa, Corynebacterium glutamicum
MPTKTYSEEFKRDAVALYENSDGASLQQIANDLGINRVTLKNWIIKYGSNHNVQGTTPSAAVSEAEQIRQLKKENALQRARTRHPAESC

SEQ ID NO: 6536 - protein, 380 aa, Corynebacterium glutamicum
MKKEKLFSLLRYIDNGSLECITSLFLITLSLTMPAIGLGNFGIQVIALSMIPLINVRFPVAALPLALVATVWLNAWADHLLLTGFIVYLAVEYATSRGRFALALILGVEWILIAYGVALERPLEAKDSPSLITEILLILVAAGTGAGRWKILSERKQRAITQQEIIKKIRTDIAHYLHDSMARSLAIMIVQSKLTELEPDPKKIQEKLNSIAKIGQEAVADLHQLVRHLVVEESAEKATAFGAWAAVSIHDTVNSAIQLLVDAGHVVSFDSRKKNYKLDHIAETAFALAFNEAVCNAIKHSPPKANVTIRITEKAQSLQILVMNPIGDWHANGESAIPGVGIGVESLTRRIRNIKGQVCVTSLQGYWKVVISLPLKCEDS

SEQ ID NO: 6537 - protein, 206 aa, Corynebacterium glutamicum
MLGPIQVLIVDDEPFFINALETYFSTNENINVVATAENGVQALDILSKTIVDVVLCDVRMPLLSGVELMKILAEKKLTCRVLALTSFLDDYAMLSMLQFGAFGFLLKSADRDEIIEAVQSAAMGGTTISPEIATNLRKFLSQPPSSISDLPTRERDVLTLLHLGKSNADIAAELKLSTVSVKKSVSRLMQRFQVSSRLELVASTRL

SEQ ID NO: 6538 - protein, 75 aa, Corynebacterium glutamicum
MRLITSQPRPARPIGQPGIFGNHVHRNLINLSIVDFPIKPEPLMDLPKEKLPDCWNLISQADFRGVEKLTDVYQY

SEQ ID NO: 6539 - protein, 430 aa, Corynebacterium glutamicum
MAAIVIVGAQWGDEGKGKATDILGGLVDYVVKPNGGNNAGHTVVVGGEKYELKLLPAGVLSETATPILGNGVVINLEALFEEIDGLEARGADASRLRISANAHLVAPYHQVMDRVQERFLGKRAIGTTGRGIGPTYADKVSRVGIRVQDIFDESILRQKVESALDYKNQVLVKMYNRKAIVAEEIVQYFLSYADRLRPMVIDATLVLNEALDQGKHVLMEGGQATMLDVDHGTYPFVTSSNPTAGGASVGSGIGPTKITSSLGIIKAYTTRVGAGPFPTELFDKWGEYLQTVGGEVGVNTGRKRRCGWYDSVIARYASRVNGFTDYFLTKLDVLTGIGEIPICVAYDVDGVRHDEMPLTQSEFHHATPIFETMPAWDEDITDCKTFEDLPQKAQDYVRRLEELSGARFSYIGVGPGRDQTIVLHDVLADN

SEQ ID NO: 6540 - protein, 253 aa, Corynebacterium glutamicum
MPTRKDLKILDDVAFDVLPQDPTPSLDEIAKQPDVEHLSSPKFAPQQPETRLRIVVIGSDAALSAVLTRLMRADNLWAEIGFVPVGPSTAAKNWGLPADEAAALELALTGLVNPAPLIRDDVAVAVAGSATITNWEPGEITGEVIVDDHVLIRHEAASKAPRRGVYGARLVPMLDAPGIAAVIMDTPLPGEVPSRSLFPRPSGSVIPESFSTGRAMQAGGPSLQIRVDGISRKRKVERVTFYRHLRDLQIVRP

SEQ ID NO: 6541 - protein, 88 aa, Corynebacterium glutamicum
MAPATSLPLESGNNILFPPMYDLVWSVIPFVILLVVAITVATVEYTRKRDVVASLGWGALVLFLPIIGFVIWAVAALIRRENRTAIKG

SEQ ID NO: 6542 - protein, 389 aa, Corynebacterium glutamicum
MAKKKLGTVARLSELDKSLRNRLLRVRSRLLFIVHSAIGAGVAYWIAVEVIKHGQPFFAPMSAVIILGLSGGDRIKRATELTLGCALGVGLGDLLIMQIGTGYWQIFVVVGLALLVASFVSPAPLVSNQMAIGGILIATMFPPGDGGSIDRMIDAFIGGGVGILVIALLPSSPLDAGRHQVANVLGIAASVLEDVAASLKAKDAAKLNNALEALRRSQASVNKLETAASSGKEATTVSPFLWGDRARVRSLYRILAPVDNVIRNARVLARRAVVLTEDNDTVSDEQIHVIEEIADIALRLSDLYEHHKEISEALEIPELVNRLRQLGSEVGEDIAEDRVLSAQVILAQSRSIIVDLLQICGMSRESAVAVLVPTSESPAYPPELWDDED

SEQ ID NO: 6543 - protein, 344 aa, Corynebacterium glutamicum
MPIATPEVYNEMLDRAKEGGFAFPAINCTSSETINAALKGFAEAESDGIIQFSTGGAEFGSGLAVKNKVKGAVALAAFAHEAAKSYGINVALHTDHCQKEVLDEYVRPLLAISQERVDRGELPLFQSHMWDGSAVPIDENLEIAQELLAKAKAANIILEVEIGVVGGEEDGVEAKAGANLYTSPEDFEKTIDAIGTGEKGRYLLAATFGNVHGVYKPGNVKLRPEVLLEGQQVARKKLGLADDALPFDFVFHGGSGSEKEKIEEALTYGVIKMNVDTDTQYAFTRPIVSHMFENYNGVLKIDGEVGNKKAYDPRSYMKKAEQSMSERIIESCQDLKSVGKTTSK

SEQ ID NO: 6544 - protein, 317 aa, Corynebacterium glutamicum
MGKLTSNRYYDDKAWLALALGRAGKVRKVRTPKSLPSLEQNIVDGIDSLTGVLPWRSGETFYNVPSNGPAAIMMARTDRLDEAMKITDWIFDNLIDGDGLVMDGLRMRMHGPELVRSIHPYCQGVAIGACLEIALKLRERAGLTTTVVDHWSDADKAEDSLKYFAHIHAVVQAVSRKMTNFHGVIDWDTGDGDGGLFKGILVRYLADVAIRLPDDSPTNRETKKIAARLVLESAESVWNHRLEVDGLPVFATDWTTDARLPQNFGLSSSSLSDLVSVVRVDERDLSVQLSGWMLMEAAAKVAEELENNGNSYTGRSR

SEQ ID NO: 6545 - protein, 206 aa, Corynebacterium glutamicum
MGKGPWEEENPGVPRPTSPLFDVTLLNEGDRRNVVDAYRYWTREAIVEDIDTRRHSLHVAIENFENDANIGTVVRTANAFAVNTVHIVGRRRWNRRGAMVTDRYQHLMHHEDVDSLLAWAIAERLTIVAIDNTPGSVPLETAELPKNCLLLFGQEGPGVTEAARAGALMTCSIAQFGSTRSINAGVAAGIAMHAWIRQHADLSQAW

SEQ ID NO: 6546 - protein, 184 aa, Corynebacterium glutamicum
MSSNSINAEARAELAELIKELAVVHGEVTLSSGKKADYYIDVRRATLHARASRLIGQLLREATADWDYDAVGGLTLGADPVATAIMHADGRDINAFVVRKEAKKHGMQRRIEGPDLTGKKVLVVEDTTTTGNSPLTAVAALREAGIEVVGVATVVDRATGADEVIAAEGLPYRSLLGLSDLGLN

SEQ ID NO: 6547 - protein, 324 aa, Corynebacterium glutamicum
MQSEQPQAPATAEVAADEEQRGVDKHSFLSSLPGSQRRERRNWAAKHHFDFIKEDAFLTDEWSRGAASTGAVARDVVSGMAEGYETHLVDLAGVPVMAMRRGITSDVVIDARRGEQPADPEREESDDLVEIDTVSGFRLLSNVAGVAQRFVDERIHVGLDSMPEAVTAVWMESDWVLAETIKGSTPSDWEEILRPLALLTDASFTLPPRSTRAQTLDLKHLEPSRLKPEQPEKPAFTPNASEEDLSQPLVIRPEEPLQMPVRGVQESRGVVEPRSLGADDVESIAEGDPERPSDLYGTRVLRDLNGQSSIFQDSTDADEPPKKW

SEQ ID NO: 6548 - protein, 284 aa, Corynebacterium glutamicum
MVTLTPRLGAMTVLISPSTLAESIHAGKKQTVLAAFWAPIEGAGRTVFCSEHIPTSIFCDPALELSGVPSSEDGRNPLPPLNVLARSFRTWGLNTDREIVFYDQGRGLFAARAWWILRWAGMPNVRILDGGFQKWEDHELGHAGGPGNFPHFCNVRPNPGQLSVATIEDVKAHQGILIDSRDEQRFAGRSEKLDLKAGHIPGAININAKSLLEDDFTFKSPEEIRQIFADKGVTSGENVIVYSGSGNHSSQLLAGMEHAGLTGASHYFAGWSQWSANPENPIEA

SEQ ID NO: 6549 - protein, 240 aa, Corynebacterium glutamicum
MKIDELIALAAEQPTRISRRSGVSRSTLKRVGDGTSEPTLSTLREVALALGLDIKVAAHHACDPFAAAAARTLIDASVPENPHNQEILAWLHRFERWNINDPLTLVSEAGTLQGITHRQDAQFVKLNPRGIAELPELFQQHKTKWALSGAAAATVIMGQIVLGNSIVWHEPAHDLDVSALGTIVDVAEDADLILLPATVTELVGSYTQDRLNFVAPVQLVIDLHSLHMFEEADYLTSGWR

SEQ ID NO: 6550 - protein, 93 aa, Corynebacterium glutamicum
MFIYSLTLNQVLLAIAFIGLLVALSWGINKFSTVRFWKKRAPVWQVGAMIILCFVANGFPAEPIYAASLGVASGLFVFLSLVQQARKANQTTV

SEQ ID NO: 6551 - protein, 133 aa, Corynebacterium glutamicum
MGKQEKLRIPLDVPGVESEEVGVELLAEGYYLVATLPAVAQDCALGDVVRAHHVDEVLEFQEVAVAGGNKTLRVLVDAIAADHVRAQLETLGLHVEAPMSEMLTVNIAPDSPSHGLEILLDDLHAQGVIFRAL

SEQ ID NO: 6552 - protein, 59 aa, Corynebacterium glutamicum
MRIMARSSSKRNSATALASSVLPTPVGPRNRKEPVGRFGSATPARERRTASDTAVTASS

SEQ ID NO: 6553 - protein, 254 aa, Corynebacterium glutamicum
MDLVAFLQSTKNTDGIFYRWLTDINLLEPTLQGSVLFDVLAVLIQRGGTNQAQLTAGKQWLNHVSGIHGGFTRSTSADDGVQLIDEGNDFAVSSLDLIQNSLQSLLEFTAILSAGNHGTKIKTDQSFALEGFWNVTSNDAACKAFHDGGFTDTWLTDQNRVVLGTTAKHLNDATNFLVTANNRINLAFTSKLGQVSGVLFQSLELSLWILSGDTLRSTNRRESLFDGVIGCTLVGQQIRSIRLSASDTGKKYFG

SEQ ID NO: 6554 - protein, 132 aa, Corynebacterium glutamicum
MYLRYSFSVVAPTKRSSPRASSGLIMFPASMADSPEAPAPTMVCSSSMKVTTSPLAPLISSRTAFSRSSNSPRYLAPATMEPRSRLIRVLPLRDSGTSPATMRRARPSTMAVLPTPGSPIRTGLFLVRRLST

SEQ ID NO: 6555 - protein, 449 aa, Corynebacterium glutamicum
MEYTPFSLILDVGWISGLMIIGNIMRRKIPFFQTLLIPSSITAGIIGMILGPKVLGLIGWSDHLSTYTTVLIAIVFASMPYSMKFDRGVRTGMKTMWAYSTAMFVGQWGLFILLGLFLFQPVWGTDEWFGMMLPVGFVGGFGTAAAVGTALESSGAEAAMSLGFTSATVGTFAAIVGGIIFTTWGIKKGKTAAMPAQLPWDLRSGYIDKLSDRPSIGKASTNPSAIEPLALHTGIILLTVAVAYSINQWLGSMFPTVQIPLFAMSFVVGIVGMGIMRLLKKPEYLDRDTVNSVSGAATDYLIAFGIASIAPAAIADYWVPLVVLFVLGTIYCCFFFFWVAPRFFGEKWLERAIFGWGWATAAVATGIALLKIVDPKLKSGALNEYGVAYIGFAPFEIGMTIIAPIAVLAGFTMGLGWASLIVAIVIFGLAWGLKWLPERGHVRGEGKPQ

SEQ ID NO: 6556 - protein, 129 aa, Corynebacterium glutamicum
MCNDLRMNADKKMCGMNPDSQYVELAVEVFGLLADATRVRIILALRNSGELSVNHLADIVDKSPAAVSQHLARLRMARIVSTRQEGQRVFYKLTNEHASQLVSDAIFQAEHTIADGQTPPHHHREREQS

SEQ ID NO: 6557 - protein, 286 aa, Corynebacterium glutamicum
MEANSEGIRALKFSLVLMLLTTVLQAIIVSFSGSVALLADTVHNLSDALTAIPLWIAFILSRRAATQKYTYGFNRAEDLAGLFIVAMIALSAIVAAWQAIDRMINPRPMENIEWVIAAGVIGFLGNEAVAMYRIRVGKRIGSAALVADGVHARTDGFTSLAVVAGGVGVFLGFPLADPIIGLIISAMIATLLVGTIRSVGRRLMDGIEPELVEKATHAIWHVKEIESIDRLRLRWVGHRLHGDATVSTSTSSLSEATAIALEAELSVKQHLPNVDEMTVTITPSKP

SEQ ID NO: 6558 - protein, 390 aa, Corynebacterium glutamicum
MSTNYEAIIIGAGQAGLAAAHELSRRGFTPGKDFLVLDSNDGPGGAWRHRWDSLTLGKAHGIADLPGLPMNRPDPKTPASTLVAGYYGAYENEFSFAVVRPVKVSRVEPTSEDPSSPLRVSSDDGREWITRMVLNATGTWTNPYVPYIPGIDKFQGKQLHTVNYRKAEDFKGKKVLVVGGGLSAVQFLLELEGLAETTWATRRPPNFTQREFDAGWGIAVERAVRERTFNGKAPASVVRTTGIPQIPDYLAGVDRGLIVSRGMFEEITPTGVVFGEPPAERSEGLGPSAGTTLAVPESWKPYPAGTHLDVDVIFWNTGFRAALRHLAPMKLRGQGRGIELIDEVSPASDARVLLVGYGSTASTVGATRAGRVAGRVAAKRLLVDVSPHVN

SEQ ID NO: 6559 - protein, 347 aa, Corynebacterium glutamicum
MKAFGFLSFGHYQIGHERSMLKQALELAKEADAIGVNGAYFRVHHFAPQGTSPMPLLGAIIGATKHIEVGTGVVDMRYENPLYMAEEAAALNLLADGRLALGVSRGSPEPAEKGWEAFGYDGGDDPKAAGMAREKFLRFLDAIDGRPMSIASENQYPRLYHPGTPLPIFPHDPDLRKSIWWGAGSHNTAEQAARDGVNLMSSTLVAEATGQSFGDLQADQIAFYRQAWKEAGHDWTPRVSVSRSIFPIVTDRDRELFGLQGQGGDQVGILDDTRSTFGRSYAGSPDELIDQLKEDKAVMEADTLMLTAPNQMGVEINASILKNFADHVAPALEWQPNTEGLVTGYEF

SEQ ID NO: 6560 - protein, 254 aa, Corynebacterium glutamicum
MGRPQRLNRQSSGLELVASNQTFSVWLPLQCWGDMISEVLQDRRVDLNTHLVGGGEHQGVGFHHSFVFLELVDEFIGTSGVAATERGSGIIQDSYLVTALSLKSEKLTVAVGDDREDGPGDRHTWGPIVSGFFPSLAVERDLIGLQIPEGLAGGFGDEGGAHQVNAIACCLFGGVVGTGAPPNGFTQVRIMREDRQGSARMVEAWVLILGSDGHGATIDGIEEAKEFLPCHACSFRIITAVVAESFPTLLGWFG

SEQ ID NO: 6561 - protein, 382 aa, Corynebacterium glutamicum
MNFYPPSVPINPAWRPPTVTVQAGRPARTPGAPMNPPITLSSTYVHDSEKAYGRDGNDGWGAFEAAMGTLDGGFAVSYSSGLAAATSIADLVPTGGTVVLPKAAYYGVTNIFARMEARGRLKVRTVDADNTEEVIAAAQGADVVWVESIANPTMVVADIPAIVDGVRGLGVLTVVDATFATPLRQRPLELGADIVLYSATKLIGGHSDLLLGVAVCKSEHHAQFLATHRHDHGSVPGGLEAFLALRGLYSLAVRLDRAESNAAELSRRLNAHPSVTRVNYPGLPDDPQHEKAVRVLPSGCGNMLSFELDATPERTDEILESLSLLTHATSWGGVETAIERRTRRDAEVVAGVPMTLCRVSVGIEDVEDLWEDLNASIDKVLG

SEQ ID NO: 6562 - protein, 189 aa, Corynebacterium glutamicum
MEDDLSAALVKALFDARTQRRLSISALAESSGVSRAMISRVENAEAQPSAALLGRLSGALGMTLSELIAQAEGGYDRGARRSKQSVWTDPATGYTRRAVSQPSESPLELVEVMLPPGAEVGYPADAYRFMDQVVWVLEGAVRITEGEEVHELSTGDCLRFGPPRDTDFANPTTVATRYLVALDKRVPRA

SEQ ID NO: 6563 - protein, 80 aa, Corynebacterium glutamicum
MNNQLDQGPLFHGTIARLQPGDLLKPGHKSNYRPDIIMNHVYFTALINGAGLAAEIAAELDAGLSDDVFQFPGKLREFMK

SEQ ID NO: 6564 - protein, 61 aa, Corynebacterium glutamicum
MKPLGSFDNDPNVTDKKFPGNPTRSYRSDELLQIIREITDWTRLTPEALAKWRERLRNYPQ

SEQ ID NO: 6565 - protein, 375 aa, Corynebacterium glutamicum
MPIVTFEDWNESFLQTGLPFELLGQVQGKTLEDEPFADMGEAKLRIKNFESVNASKIVHALYFPNLKYLRFTLPQSVDKFFILSPSIPPRVAELLREQGFMFADQRGNGFASWPGVHIDVRGKTSTDSSKKIKRRTPDRRTASLFTPRRAQVSGALLAQPAILRSPIREIADSASVSVGTAIQTLELLTEAGYLRKIESGYRLMKGDALLDSWAHAYPTGLGVSQQTFRGNGDLNRFKNIEPLGWISGEQAVPKLISGGNTAHIYVNDDSDDKATNKIIQQGRLRRDDTEGQVLVRRAFWRQSKKHNESYHKRNLSLAFPTPFNMWPIAPLPVIYADLLSVGDPRLSEVAYIIKTQIQEYTDHDEFTERGHYFSS

SEQ ID NO: 6566 - protein, 244 aa, Corynebacterium glutamicum
MLVGARCRDIHQQKYRDQTAGRRTKDVDFALALESWDDFNLLKQQFSPTGNAWQGITIGNIPVDLVPFGNIENPPGEVLSRKGHLLNVAGFKEVFEQAELYPLNDAIDIKLSTVPGLTALKLHAWLDRKENNIKDASDLALILSWYEEDVETLWNRYFALENQGYIGEPEAMAAELLGLDTGRILGHKETQALLDRFNEQSPPELNQFAESLEAPPEHSHPLERRRIQVEALLGGLRDSLGYDE

SEQ ID NO: 6567 - protein, 393 aa, Corynebacterium glutamicum
MIRCTIGSVTPRPVSSVARLVEDNAQDFLRAVQAKLLTLAPQARGHFPTADDATHISIAEMVSALLEGTGEEGKVDDKTLEFFKEAALDARRFGLTPEMHSALGEAVRSELLSLCEDLPFENVLFAERAIAATTAVSVEAVREADEAHIPASYQAEIVEVEKRSRRFTVVRMQAETQLPYLPGQYLAATADFLPNTWRYLCPSIPTNEWGQVEFHIQSDADDIAGLLATTRLGDKWRLGPGRGDFGQSKISSGNDLLFIAHGTGLAPLRAYMFELMNQAAPPRLHFFVGADYPGELYELTGMWNFAAASPWLSVVPVSTHDKDAWWVQATEASQPPRGLHLHQTGSMAKIVTEAGAWADRDVLIAGPESWARDVRRAMIRRGTPAQQIEILGF

SEQ ID NO: 6568 - protein, 266 aa, Corynebacterium glutamicum
MRIALLQISTNSDKMDNFALLRDAAEKAAEQGARVLVFPEATSQSFGTGRLDTQAEELDGEFSTAVRKLADELDVVIVAGMFTPADTVQRGEKTISRVNNTVLISGAGLHQGYNKIHTYDAFGYRESDTVKPGDELVVFEVDDIKFGVATCYDIRFPEQFKDLARNGAQIIVVPTSWQDGPGKLEQWEVLPRARALDSTCWIVACGQARLPEELRDERKGPTGIGHSMVTNPHGEVIASAGYEPEMLIADIDVSGLAKIREALPVL

SEQ ID NO: 6569 - protein, 81 aa, Corynebacterium glutamicum
MYLQTDLPNHLIHRDITYPSPTLNCTPSHTATALSSANQHWRLLLFDANLHLNNHLSDMRTVSEQMLNIDVDLGHTLNKLH

SEQ ID NO: 6570 - protein, 378 aa, Corynebacterium glutamicum
MLALKSSELEGIATSLTAVAGALHESNTDRLQSWQQLETMTSASSLIQGFIKLVDYNRPTVNIVEQMHKTASTLFNTADFLRTLEGYVDVLEKQADKSITLTVMLRYIASLSSLLDLMCAREINALCTAITPEPLKHLGDFGTLPASAIHEFHLVNAPPEIRALAEAHPDMQILEAGDGSLVASFGDIDRATTVTTIVAGVGSSNPEGWNTYVDRARTVSASTGSATVLWLGYQAPASIPAAVSGAAANRAAADLQRFQAALQSRNPHQRKVVMGYSYGSTVVGKAASSGELSADALVLVGSPGAGVSHSSQLGAPVYAVTGSADPIGFAGTQYDGIHGTDPTAALFGATVWDSPSTHSGYWNDQEFLGNVAEVVRGK

SEQ ID NO: 6571 - protein, 110 aa, Corynebacterium glutamicum
MDGDLPPSSRVTGMILSDAARLISLPTSVEPVKAILPIRLEPDSAAPASPPSPLTMLRTPSGMRSPMMLIRYKMDAGVCSAGFMTIALPAASAGASFQVAMRIGKFQGMI

SEQ ID NO: 6572 - protein, 506 aa, Corynebacterium glutamicum
MTVYANPGTEGSIVNYEKRYENYIGGKWVPPVEGQYLENISPVTGEVFCEVARGTAADVELALDAAHAAADAWGKTSVAERALILHRIADRMEEHLEEIAVAETWENGKAVRETLAADIPLAIDHFRYFAGAIRAQEDRSSQIDHNTVAYHFNEPIGVVGQIIPWNFPILMATWKLAPALAAGNAIVMKPAEQTPASILYLINIIGDLIPEGVLNIVNGLGGEAGAALSGSNRIGKIAFTGSTEVGKLINRAASDKIIPVTLELGGKSPSIFFSDVLSQDDAFAEKAVEGFAMFALNQGEVCTCPSRALVHESIADEFLELGVKRVQNIKLGNPLDTETMMGAQASQEQMDKISSYLKIGPEEGAQTLTGGKVNKVDGMENGYYIEPTVFRGTNDMRIFREEIFGPVLSVATFSDFDEAIRIANDTNYGLGAGVWSRDQNTIYRAGRAIQAGRVWVNQYHNYPAHSAFGGYKESGIGRENHLMMLNHYQQTKNLLVSYDPNPTGLF

SEQ ID NO: 6573 - protein, 146 aa, Corynebacterium glutamicum
MASTPKKSNDEGQFDRVDFQGEVFVISVAAELAGMHAQTLRTYDRMGLVTPIRTRGGGRRYSRADVELLREIQHLSQEEGVNLAGIKAIIELGEENRNLKESLRKVTAENEQLKDQLRSGRPRGELVHVPRSTAVVMWERRKGRSK

SEQ ID NO: 6574 - protein, 395 aa, Corynebacterium glutamicum
MNNSEWANKNYYADLGVSSSASEDEIKKAYRKLARENHPDKNPGDKAAEDRFKKAAEAYDVLGDDKKRKEYDELKALLASGGIRGGFGSGGAGFPGGFRTSTGGFDTSDLFGGGQGGGFSTDGGLGDIFGGLFNRGAGSHQSARPTRGADVQTEITLSFVEAAKGTTIPVELTGDAPCNTCHGSGSKSGHPAKCGTCDGTGFTSENKGAFGFSAPCATCGGTGEIITDPCDNCHGRGTVRKSRSITVRIPTGVEDGQKVRLAGQGEAGPNGKPAGDLFVKVHVKKDDVFTRDGSNILITIPVSFSELALGGAISVPTLNKPVKLKLPAGTPDGRTLRVRGRGIEARDSTGDLLVTVQVSVPKNLDDNAAEALRAYAEAETNSGFDPRANWAGQNR

SEQ ID NO: 6575 - protein, 212 aa, Corynebacterium glutamicum
MPDNPGDPENTDPEATSADRAEQAAEEAAARQAEESPFGQASEEEISPELEAEINDLLSDVDPDLDGDGEVSAVETQLAERTEDLQRVTAEYANYRRRTERERQGIIDTARAGVVTQLLPLLDDLDLAEQHGDLNEGPLKSLSDKLINILGGLKVESFGEIGEAFDPEIHEAVQDLSQGDVKVLGTVLRKGYRLGDRVIRTAMVLIGDPEES

SEQ ID NO: 6576 - protein, 618 aa, Corynebacterium glutamicum
MGRAVGIDLGTTNSVVSVLEGGEPVVIANAEGSRTTPSVVAFAKNGEVLVGQSAKNQAVTNVDRTIRSVKRHIGTDWSVAIDDKNYTSQEISARTLMKLKRDAEAYLGEDVTDAVITVPAYFEDSQRQATKEAGQIAGLNVLRIVNEPTAAALAYGLEKGEQEQTILVFDLGGGTFDVSLLEIGDGVVEVRATSGDNELGGDDWDQRIVDWLVEKFQSSNGIDLTKDKMALQRLREAAEKAKIELSSSQSANINLPYITVDADKNPLFLDETLSRAEFQRITQDLLARTKTPFNQVVKDAGVSVSEIDHVVLVGGSTRMPAVTELVKELTGGREPNKGVNPDEVVAVGAALQAGVLRGEVKDVLLLDVTPLSLGIETKGGVMTKLIERNTTIPTKRSETFTTAEDNQPSVQIQVFQGEREIATANKLLGSFELGGIAPAPRGVPQIEVTFDIDANGIVHVTAKDKGTGKENTITIQDGSGLSQDEIDRMIKDAEAHADEDKKRREEQEVRNNAESLVYQTRKFVEENSEKVSEDLKAKVEEAAKGVEEALKGEDLEAIKAAVEKLNTESQEMGKAIYEADAAAGATQADAGAEGAADDNVVDAEVVEDDAADNGEDKK

SEQ ID NO: 6577 - protein, 444 aa, Corynebacterium glutamicum
MPDTVLDAIEGNFEPPLNTQKSAVPPNAEATVEADSEGTTDRSVILGRDGRWLSGWALRFIVLVIAGVIALRMLGFIWVGILPVVLALLVCTVLWPPVKWLREHKIPAALAVVITILGFFALIGGVFAAIAPSVSSQTKQVVDQATVGIEDLMDWVQGPPFNLDISQFEGALNDLTSMLQSQSSTIASGVFSGLSTASSIVVTLAVMLVLTFFFLKDGPRFLPWMRGFTGENAGWHLTEVLTRTWNTLAGFIRAQALVSMVDAIFIGIGLLLLGVPMALALAVITFFAGFIPIVGAVSAGALAVIIALVTNGVTNALLVLVLILAVQQIEGNILSPFLQSKAMNLHAAVVLLSVTVGSTMFGIIGAFLAVPVAATLAVWVRYHSEMVALRAGEITSDDIEIATTKGSPTSLNGQETLAAIRSRFAILGRKKPTSATAEKADSES

SEQ ID NO: 6578 - protein, 211 aa, Corynebacterium glutamicum
MKLFQSCFLLNNSACNLLVVLCLVTMTETLFVSATTEEAVYLPDGIDLLVTGIGTTAATMILTKELATREVLPARIVNIGTAGALVDGLAGVYEIEYVLQHDFSSELIAEMTGKPCSNGSTLATSGHFPVASLATGNSFIADSETRNHLATRASLCDMEGAALVGVAKHFGVPITLLKQVSDSADEEASGSWFDAVDAGARQLAEAVKEFK

SEQ ID NO: 6579 - protein, 400 aa, Corynebacterium glutamicum
MSAPPSWSATPKNQTPRAQFRAIPVSLGSRNNMPLFIDDALHRSKKYFHAHLSELLLGEFAGLSLPLHPPTAAKAAADIDATREFIRQWEGRDDVEYAIRNWSPVGLGKTEVPVRLTLNTTEELVVFAQVEDEWSSLHERFSQLSGFTAEVVAKHVSLWRSLSNDDLSKAVLVVDWFLKHPNSGLLKRAVAVEGVHTKWLENHRVLIETLVADKRGEPGRADLGLGDAEARVRLRFHSVDAPAGLTDIEVPLSNLCELQEPQVILMVENLDSFLALPTWPGVTIAWGAGYRAVDIVRGPYFSNGRLLYWGDLDLDGFKILDGVRSHVPHTESVLMNSETVSRWRYLGVADREFKAESFDNLHDFESDALDLLITDGELRIEQERIRLDVAVEEIEKVIRG

SEQ ID NO: 6580 - protein, 295 aa, Corynebacterium glutamicum
MFGIYPIPNPWQQPMRNQHFRSKTTQNALHNGFPFRIIRINQLTGKGHIPRAHAQILTQIFPHLQQTVLNITAAFTQRRQLLIRRFELINRTGSVLYIPLTCRFKRFPRRRILIHGQPRSVVELQKLLRRFRRRTAQPLNQCVQTSARSANCSSLIDGPLPLRTQNSMLRSHNLFDVVVREGFHFAGTICLNFGGLHLRLRLRLLDSKLSNQRFLLFLLNAIPDSRQRLLQCIGMIFGLLRFLSPILQLHQRIQGVDLPFNIFDLLISTFKVLELFHGSFGNAERIRFHQHVIPK

SEQ ID NO: 6581 - protein, 1111 aa, Corynebacterium glutamicum
MTSEQALDPIHPGQFRLSRIQLINWGTFHGTVDIPVTREGILVTGGSGSGKSTLIDAITAVLLPQGKLRFNSAAQANTPRNKGRSLVTYIRGAWRAQEDPLQDQIVSTYLRPRATYSLVGLTYSNGEGVEHTLVAIFYLKSGHNLTSDISSYYGVFPVDQDINALLDFLKEGIDKRQIRAAFKEAIFSEQHSVFSGRFRSRLGISSEEALLLLHRAQSAKDLQSLDDLFRDYMLVEPDTFSIAKTAVEQFQDLEGAYEQVEDIKRQIHTLDPLVQLKNRREKAQQSKDHANALKKALPTVGNRIKKEEQETLVRQFTVEQTQAKSKVESAKIETDRAREMETLAHDNVKQIVGAQHGILSAKREGAVDKRRTISTARAGLDALVKGLGGAAPESAEELLELNNAARLTVDEYPAAREALESAGQRNVEDRTRAVDEFKAADQELSSLSKGSSNIEYRLLQVRENLCQDLGVSPRDMPFAGELIDPNNAEWEPVVQRILGGFAAEMLVPHGLLPRVRDWVNAKHLAALLKFNGVVTTGEYKTSRFPADSLIRKVDVVESPFRDWVNQELGKRFNIRCVRTPEELSALGPRDQGVTILGVRKFAQQTGDPTTRWEKDDRRKLGDRSTYRLGSTNDAKVETLRETVKAGKAVVQAADNRIAANRAELRELERQYQASQEILKVSWAQIDVESADAAIAELDRLLEELNNTPEATELSARHEAAKQTLARVSDLLVAAQSEETVASMNLKRAETELKRLESLPVAEVSEEIAREVEKLFLANTRRVHAANVDEQTIALREDLDKQIDANEAELRRCENQIVGILRSYIETWPANRADLQAEPEFVGEAINRLGELRSDRLAEFTAKFLGLMNEMSTRNLGQISRRLRDARREIEERIEPINASLAQSEFNEGRFLHIDIRDQSGPIVREFQQKLDAATSGDLGTSTEKQAFARYALIAEIISKLASHDSADARWRNTVLDTRRHVRFIGLERDSDGATVNTYVDSASLSGGQAQKLVFFCLAAALRYQLAEPGAHYPTYATVILDEAFDRADPAFTRQTMNVFHSFGFHMVLATPLKLIQTLGDYVGSTIVVSYTEKPNAQGAIQGNSSFSRIEK

SEQ ID NO: 6582 - protein, 212 aa, Corynebacterium glutamicum
MNDQLWEGDTGTLTFGSRKALVQLLKGPMVNALQHVEVWRAITTDQDALNAVLNNLFLELVLDEDAGVAFTRPANGRQEVLVGNNKTEAMPKVLRTETLSHFDTLIILILRQELTMAPPGERVIVDREEIREQVLLYRVDEERDEAKLAKRFDAAFRRIVDYSLAKKTETPERFEVSPALRQIFDADTVAGVRAEYEKFNKAAHDGNEEEQK

SEQ ID NO: 6583 - protein, 495 aa, Corynebacterium glutamicum
MTVVSHALGFKRFRQESLELSLLRSDNFPVVLAVVAQYFPQGAIAKPASELYQLLSDDFRVLREEGFELPKSPSDYVSDWVKSRWFVRRPGSSQTGETVEPSEELLAVLDSVQRWDNPHRSISASRIESLTQALQTLALESDPSTAKRLAELERERDRIERQIEAVHAGEFEVLTTVQIGDRVADILDLAASIPADFARVRHELSDLNRKLRRQLLDPEDSRGDVLEEIFRGVDLIGDSDAGRSFNSFFDVLLDRERSSLIDRWIREVLGRDEAIDLDSKLRTGLYRIFRDMEDASFEVNGEMTGLARSLRHYVTTEEFAESRRMIQLLRDTRSAAAKAAEAGEVTSLNHMDTPLVRIGMDVRSIAGLKLKNPGEERVEDLPEPVEEQELDTEVLMEQIRASEIDFEELEEAVSLVLAEQSHATITEVLEHFPATQGLASIVGLLYLAMRDGVPTGRAQIVEWESDDATHRRRITGWQFIRGLNSEDLAESEMDK

SEQ ID NO: 6584 - protein, 345 aa, Corynebacterium glutamicum
MTTAAPQEFTAAVVEKFGHDVTVKDIDLPKPGPHQALVKVLTSGICHTDLHALEGDWPVKPEPPFVPGHEGVGEVVELGPGEHDVKVGDIVGNAWLWSACGTCEYCITGRETQCNEAEYGGYTQNGSFGQYMLVDTRYAARIPDGVDYLEAAPILCAGVTVYKALKVSETRPGQFMVISGVGGLGHIAVQYAAAMGMRVIAVDIADDKLELARKHGAEFTVNARNEDSGEAVQKYTNGGAHGVLVTAVHEAAFGQALDMARRAGTIVFNGLPPGEFPASVFNIVFKGLTIRGSLVGTRQDLAEALDFFARGLIKPTVSECSLDEVNGVLDRMRNGKIDGRVAIRF

SEQ ID NO: 6585 - protein, 72 aa, Corynebacterium glutamicum
MPPATHSPPPQRAIKARAPYLLDRLDKHAVHNNIPRIVLVSIFKWNEYMLPVLKALPQDQIMVRRDLIELVA

SEQ ID NO: 6586 - protein, 69 aa, Corynebacterium glutamicum
MLGRRQLGFLLVDGPFFIIQLSLSNTAWILYSMILGELGKVTLRNFIRVLSLEFFAQIIDRVVSTLRTV

SEQ ID NO: 6587 - protein, 63 aa, Corynebacterium glutamicum
METGLVRLCSRISADLLERLHNNAPVLFELGLPASGGHIIKLLVSFLQVKQGDHDPAQTEQER

SEQ ID NO: 6588 - protein, 87 aa, Corynebacterium glutamicum
MDLSWERGKWGWLSPCVVRDGCSRRVLGWAWMILKRHGLLGVRCGWRIRCGVVCLMVWFFAVHIGSVVSGVSGIGDRSVDGPDWGVF

SEQ ID NO: 6589 - protein, 309 aa, Corynebacterium glutamicum
MQTLIFIAIAGVAAQLVDGGLGMGFGVTSTTILIMLAGLGPAQASAVVHTAEVGTTLVSGLSHWKFGNVDWKVVVRLGIPGAIGAFAGATFLSNISTEAAAPITSLILALIGMNLVWRFSKGRIRRDYSDRPHSRGFLGGLGIVGGFVDASGGGGWGPVTTSTLLSLGRTEPRKVVGTVNTAEFLVSLAATLGFVVGLWDDLVANLSAVLALLIGGAIAAPIGAWMISRVNATVLGGFVGTLIVTLNLPKVLNVVGLDFIPTGLIQVTVLLIGLPLTYLGFRRYRKNLLNETISSEVVSEPKGQKIKST

SEQ ID NO: 6590 - protein, 241 aa, Corynebacterium glutamicum
MIPLITLSHGSRKKSAAAGITALTHEAGRMLETPAVEAHLELAEPSLDQVVATLSAEGVTRAALVPLLFSNAYHAKIDVPEAVKDASEKYGVELLVGPHLGTGSDVASVLAQRLSADAPTDAHVILYSVGSSHVSANESVIDLAHTIALLTGFSVEVVPATGGPGAGGAGVIEVASKHKAVHILPLFVTEGLLLDRAIDQSANIAAATGTNFTYSEPLTTDLAPLVAARYHAALSALLAHI

SEQ ID NO: 6591 - protein, 305 aa, Corynebacterium glutamicum
MLYSRLEQSSEVAFLLAVFHCGFAEAVIGAGCATFGKGGGGDLFDHIVNGAGFGEHSTGAGHIADGAVADSLGDDLLALLWSTPLACGQPHAVALENFAVVGEVDRWKFDATGADVLPNVSFSPVGDWENTDVFAWQVATVVEGPQLWALTAWIPTTEGVTHREHTLLGAGTLLIAASATKHCVVALLSDGLHQRDSLQWVAGAVWAFLQVTAIDPVLDFSYAQAGAGALHQVVAEFQNLWEVVAGVHVQQFKRHVSWSESAARKLVHHDGILTAGKQQADLIKLASYLAEDVDGFIFKIFKVWG

SEQ ID NO: 6592 - protein, 433 aa, Corynebacterium glutamicum
MTAPTLNKASEKIASRETLRLCTAGSVDDGKSTFVGRLLHDTKSVLADQLASVERTSADRGFEGLDLSLLVDGLRAEREQGITIDVAYRYFATDKRTFILADTPGHVQYTRNTVTGVSTSQVVVLLVDARHGVVEQTRRHLSVSALLGVRTVILAVNKIDLVDYSEEVFRNIEKEFVGLASALDVTDTHVVPISALKGDNVAEPSTHMDWYTGPTVLEILENVEVSHGRAHDLGFRFPIQYVIREHATDYRGYAGTINAGSVSVGDTVYLPEGRTTQVTHIDSADGSLQTASVGEAVVLRLAQEIDLIRGELIAGEDRPESVRSFNATVVGLADRTIKPGAAVKVRYGTELVRGRVAAIERVLDIDGVNDNEAPETYGLNDIAHVRIDVAGELEVEDYAARGAIGSFLLIDQSSGDTLAAGLVGHRLRNNWSI

SEQ ID NO: 6593 - protein, 304 aa, Corynebacterium glutamicum
MTTTVASVLSPHLKDLENESIHILREVAGQFDKVGLLFSGGKDSVVVYELARRAFAPANVPFELLHVDTGHNFPEVLEFRDNLVERTGARLRVAKVQDWIDRGDLQERPDGTRNPLQTVPLVETIAEQGYDAVLGGARRDEERARAKERVFSVRDSFGGWDPRRQRPELWTLYNGGHLPGENIRVFPISNWTEADIWEYIGARGIELPPIYFSHDREVFERDGMWLTAGEWGGPKKGEEIVTKTVRYRTVGDMSCTGAVLSEARTIDDVIEEIATSTLTERGATRADDRLSESAMEDRKKEGYF

SEQ ID NO: 6594 - protein, 231 aa, Corynebacterium glutamicum
MSPEVAKHNEELVEKHAAALYDASAQEILEWTAEHAPGAIAVTLSMENTVLAELAARHLPEADFLFLDTGYHFKETLEVARQVDERYSQKLVTALPILKRTEQDSIYGLNLYRSNPAACCRMRKVEPLAASLSPYAGWITGLRRADGPTRAQAPALSLDATGRLKISPIITWSLEETNEFIADNNLIDHPLTHQGYPSIGCETCTLPVAEGQDPRAGRWAGNAKTECGLHS

SEQ ID NO: 6595 - protein, 561 aa, Corynebacterium glutamicum
MTTTTGSARPARAARKPKPEGQWKIDGTEPLNHAEEIKQEEPAFAVKQRVIDIYSKQGFSSIAPDDIAPRFKWLGIYTQRKQDLGGELTGQLPDDELQDEYFMMRVRFDGGLASPERLRAVGEISRDYARSTADFTDRQNIQLHWIRIEDVPAIWEKLETVGLSTMLGCGDVPRVILGSPVSGVAAEELIDATPAIDAIRERYLDKEEFHNLPRKFKTAITGNQRQDVTHEIQDVSFVPSIHPEFGPGFECFVGGGLSTNPMLAQPLGSWIPLDEVPEVWAGVAGIFRDYGFRRLRNRARLKFLVAQWGIEKFREVLETEYLERKLIDGPVVTTNPGYRDHIGIHPQKDGKFYLGVKPTVGHTTGEQLIAIADVAEKHGITRIRTTAEKELLFLDIERKNLTTVARDLDEIGLYSSPSEFRRGIISCTGLEFCKLAHATTKSRAIELVDELEERLGDLDVPIKIALNGCPNSCARTQVSDIGFKGQTVTDADGNRVEGFQVHLGGSMNLDPNFGRKLKGHKVIADEVGEYVTRVVTHFKEQRHEDEHFRDWVQRAAEEDLV

SEQ ID NO: 6596 - protein, 457 aa, Corynebacterium glutamicum
MTTPLRVAVIGAGPAGIYASDLLIRNEEREVFVDLFEQMPAPFGLIRYGVAPDHPRIKGIVKSLHNVLDKPRLRLLGNIEIGKDITVEELRDYYDAVVFSTGAVADRDLNIPGIEAEGSFGAGEFVGFYDGNPRFERSWDLSAQSVAVIGVGNVGLDVARILAKTGDELKVTEISDNVYDSLKENKATEVHVFGRRGPAQVKFTPQELKELDHSPTINVVVDPEDIDYDGASEEARRASKSQDLVCQILEQYAIREPKDAPHTLQIHLFENPVEVLQKDGKVVGLRTERTSLDGNGGVNGTGEFKDWPVQAVYRAVGYKSDPIDGVPFDENKHVIPNDGGHVLTAPGAEPVPGLYATGWIKRGPIGLIGNTKSDAKETTDILIKDAVAGVLEAPKHQGEEAIIELLDSRNIPFTTWEGWYKLDAAERALGEAEGRERKKIVDWEEMVRQAREAPAIV

SEQ ID NO: 6597 - protein, 361 aa, Corynebacterium glutamicum
MKGKHVKPAFDDTLEGFEYVLDAVTGRTPISQQWIRNLHAVILRSQESHEVFTAVGVQNQALQKGEYKTQPNSPQRSDGSVHAYAPVEDTPAEMARFISELESKEFLAAEKVIQAAYAHYAFVCIHPFADGNGRVARALASVFLYKDPGVPLVIYQDQRRDYIHALEAADKNNPLLLIRFFAERVTDTINSIIVDLTTPIAGKSGSAKLSDALRPTRVLPELHDAAHRLQESLFTEIRSRLDEEGKRNGLEFLLQRIFIGSPFNLPEGYNAFPDSYCLTLAFNSNSPKQIFHPLSIVIAARDGKRASSDLVAATSIGYNFHAYGREVEPVVTESFRERVKIYADGIVDHFLTELAKKFQQN

SEQ ID NO: 6598 - protein, 79 aa, Corynebacterium glutamicum
MILSIEEKVVAMKEDLQRRAVVKAFIIFLLGVLTGMYISIMYANALVALGFMIAGLVVAVLVYMVNRPRKVESESPRLE

SEQ ID NO: 6599 - protein, 178 aa, Corynebacterium glutamicum
MSSKAILQRTINRTPRNSFQRHGHGAALRQLLPVATNFLFQLSATSQRQRSVLALHSLHHARNITGKKQLLTINDQLSVHDFLAVTTNFLLRMHGGKRHHLKLATKNCLVELHCFFGISIELTVRGEIGFHRIPAFQARAFSVTHITLESMRQSASRHVTLLSTATRPKNLRDSARSS

SEQ ID NO: 6600 - protein, 138 aa, Corynebacterium glutamicum
MKADLTPYRQFNGNAKEAMEFYQTVFGGELQMMPFSAMHSEEEVGGDGEKIMHAELVVDGQKLLFASDIPRVMQRMKGEDTPLSLTGGAELEEEIRGYWEKLSEGGTVTMPLEAVPWGAVYGALEDRFGTHWMFNIGG

SEQ ID NO: 6601 - protein, 122 aa, Corynebacterium glutamicum
MSPSSAPPPDQKIYEIARDLPRLPAWASGLASGTLSLIDANSLHLESPMGLVHTEFTPINTYGILDHVVTLPDGTKVLNPFRVIPHDTGSELIFTVRPNENFEEDCQAVAADLERLVALAEK

SEQ ID NO: 6602 - protein, 174 aa, Corynebacterium glutamicum
MLAAFRQYGIQPGPLLFDRNPELVWALLASFFIAMIVLLFINLPFAQLWAKLLLIPNHYLYSGIALFCGLGIYATSGAVFDLLMLLGIGVVALIMRRYGYPLAPLMIGMVLGPLAETSLRDALLSSVGDFSILVSSPITWSLYAVLAIFIAVSVITAIRGRRKHLTSQLETIDA

SEQ ID NO: 6603 - protein, 107 aa, Corynebacterium glutamicum
MKRSMPVTESMPMVAMPRPKMRDASPLNTESDTTEEVATNAKSASAKYSAGPNAVDSSARVGARKTTMKEETIPPMKAPIAAVARACGARPLRAMRWPSNVEAIADA

SEQ ID NO: 6604 - protein, 162 aa, Corynebacterium glutamicum
MRHRLWLPQRSVPSSAVSSPPSSWSSSHQPWRNCPPHSAPPSTSHWHSSRSSPPPPWCPTPCLRDLRPSFSASALRPSASIRSPASSASRSGHRSFSTEFPSLLLPSRFWHWEKCFTLQPAHAVTKQIWRRALQAVRGLPERNSKKPLQPGHAEPSLVCLSV

SEQ ID NO: 6605 - protein, 95 aa, Corynebacterium glutamicum
MFIKIAIVESPKRPPKYTPENIMNAAVGSSAKVIGSSSATAMEDPRPGMTPTAVPSKQPTITQRRFIGVSAPAKPSIKRDKISIKSHHPKVRKED

SEQ ID NO: 6606 - protein, 188 aa, Corynebacterium glutamicum
MNVTEQSGESHIDIPESHQLPGPRPVGEGTFWEGRSGLIMPAILTAFSLYLLIGVLNMDVGNAAFPGPRFFPTILGIAGLLVAVALTIQTIKYPMHPENESGRSWKFHSDYVSLAWAIGGFFAFAVLLPYLGWVLAGSLLFWTMTRAFGSKRPGFDVLVSLMMSSVVYLAFDVGLGLNLPSGLLGGGF

SEQ ID NO: 6607 - protein, 334 aa, Corynebacterium glutamicum
MAEVGAEPAGSAQSKTKQFVVGTAAVVITAIAAFFSIQSASGGEDIRSNMTLIAPAAAGGGWDTFQREQQQSMRVNKIVNNIQVVNIPGAGGTIALGKLSTMTAPNTLMVGGTGHIAAQIQFDTPAKIQDVTPIARVVEEFDIITVPADSPYNTLEELIEGWKADPAGVSWTGGGSFDQLVMTEIALSAGIDPKQTTFIPSDGGGEAIQALLNGTAKASTGGFADMYPQVEAGRLKVLGIAAEERLPGSDIPTLVEQGYDVTLTNWRAMFAPPGLSDDQIAELRAIVAESVETAEWQSAVERNYWMNASLEGEELDQFVEDEIDRIDQLFKEMG

SEQ ID NO: 6608 - protein, 231 aa, Corynebacterium glutamicum
MGVAAAWTEKVPAFRVLREKRMLDFRAPITVITGENGVGKSTLLEAIAINAGFDTAGGEHTGKFKPSDNPLQTVAKAHKGKEPMRGYFLRAETHFNVASGYRDEAPGWVNLHHMSHGESVMHIVQNAFVGKGLYLMDEPEAGLSFIRQMAILAELNFLAESGAQIIIVTHSPVLMAIPGAEIWEFSASGELHRGFDFEVTTAFRALRDFFEDPEEIAEYMMDVMMDNKGES

SEQ ID NO: 6609 - protein, 238 aa, Corynebacterium glutamicum
MTKVSLLDHPESLPGYLSSLAIVEYLHEQPLEFRAPITVITGENGVGKSTLVEALAVGMRLNPSGGSRHANFGREGDIVSSLHQSLKLVRRENPRDAFFFRGETMYNVASYYEELMGEKNMHDLHKMSHGESVFAVIDRRFNNQGFFVLDEPEAGLSMLRQLELLGKLGNLARGGAQIIMATHSPILLAIPGAEILEITSSGVAKVNFEDAEAVRAAREFVADPRGTAAFLTAEEDHQ

SEQ ID NO: 6610 - protein, 403 aa, Corynebacterium glutamicum
MHASSPQPHPQRTRVLSGLIFAQIMVGASNGVTLSMGSLLAAHLAGASWGGSAATLTTIGAAIFSIPLARMVSTYDRRTSLSTGMLLGCVGALLAILGAQFGLFPVVLLAFLFLGSMSAVNLQARFAATDVASEETRGRDLSIVVWSTTIGAIAGPNLFEPSARFSETLGLEQHAGAYLLCLFGQLIAIAVWRFTLPKGLKPEATPNAPTEKKRLTPKALQAITSVATAHFSMVGLMSMAAIHMQGHGASLTIIGFTISLHVAGMYALSPVFGLLTDKLGRNVTIYSGFAMLATSAAFLIIWPEPQWAMITSMILLGLGWNSALVGSSTLLVDATPIHHRTYAQGRSDLTMNLAGASGGLIAGPLIAMGGMPLLAGVVLAVVALQTVLSFRTRSIEKTPASCF

SEQ ID NO: 6611 - protein, 274 aa, Corynebacterium glutamicum
MVTLRPSLSVSRPNTGESAYIPATCKLMVKPMMVRLAPWPCMWMAAMDMRPTMEKCAVATDVMAWRAFGVRRFFSVGAFGVASGLRPLGRVNRQTAMAMSWPNKHSRYAPACCSRPRVSLNRALGSNKFGPAIAPMVVDHTTIERSRPRVSSLATSVAAKRAWRLTADMDPRNKNAKSTTGNKPNCAPRIASSAPTQPSNMPVLSEVRRSYVETMRARGIEKIAAPIVVNVAADPPHEAPAKCAASKLPIDSVTPLDAPTMIWAKIRPLRTRVR

SEQ ID NO: 6612 - protein, 229 aa, Corynebacterium glutamicum
MRWQYIDGLTCTNHSLGDREMRHRVGEAGESAELCVGLRGGPAKKRLLRFWVETVRLDEALPDIVLGYLQIGGSDSAGDFTDLDNSAVTVERNGTMTSIAIDVNTTLSCTFFSNVNYYCVAAVVDWKVRSTGFGEAVFPAEEVLVFFGKPLRSESAAGFLISNANECQRATQAAFTGYLTGDGRLGCGNKEHIDGPSTPNLSIRNLRTEWIFSPFRQINRHNISMSKQC

SEQ ID NO: 6613 - protein, 441 aa, Corynebacterium glutamicum
MTLYDETLTLLQELIRNACVNDLTPDSGQEIRNAESLERFFEGTPNVKITKLEPHPGRTSIIVTVPGSDPDAEPLTLLGHTDVVPVDLPKWTKDPFGAEISDGQIWGRGSVDMLFITATQAAVTRQVAREGGLRGTLTFVGVADEEARGGLGAKWLSEEHQNLFSWKNCLSESGGSHLPVHDGSDAVVINVGEKGAAQRRIHVNGDAGHGSIPFDRDSAIVKIGEVARRIAAADLKVAKDDIWQGFVQAHRFDPETEQALLSGTSPEAYAEFGGLSRFAHAVSHLTIAQTVVRAGQAINVLPSHAYLELDIRTLPGQTNDYVDDTLRAALGDLADEVEIEHLISEEATVSPTDSRLYNTLEKVLGDFFPDAPVVPIISSGGSDLRFGRRLGGVGYGFAVHARERTLAEAMGQLHSHDEALYLEDLELTVRGYDSVVREFLG

SEQ ID NO: 6614 - protein, 635 aa, Corynebacterium glutamicum
MTFQRARFESITHPTQRHSMKQTSSRYGISPNANYPKYQRQTVTAPSRMQQETTPPMDGTSPQNKISTTPPAPGNAIPAPGGAIPTPAKTEQDAVPPTVAAKLPVPGSSIPAPGRALPTPVAPGGSVPAPRASAPAVPNVPAAPGAAVPAPGISIPAAPSAPGSAIPTPGTAIPVPGSATPVPAPGVSAPGASVPSIPVPGSVTPPAPGISAPGGALPTPGSAPPTPGGALPTPGEALPVPGAPGAPGASGIPSPGLPTPGVPTPGASLPVPGAPDAPGTPSIPAAPGIQAPGIPAAPGAPAQAAAHAKPVFQDAEKRPRTDEAGNAKKELPLRVRLAQPITRKQWAMTLGVLVLGAIVVAAIAVVLAKWAFTTEWLQDFVEKYPGKYDNPEGAPVGIPTWLSWQHFFNMFFMVLIIKTGIEINRTRRPKGYWTPKKGGKKISLTLWIHLVLDLLWIINGAVFIILLFATGQWMRIVPTSWDVFPNALSAGLQYVSLDWPTENGWANYNSLQELTYFFTVFIAAPLSIVSGFRMSSYWPKNNATMNKLIPIGFARALHMPVMVYYIVFICIHVFLVLATGALRNFNHMYAGQDVVNWVGFGWFVASLVVIIGAFVALRPTIIAPVAKLFGQVTAR

SEQ ID NO: 6615 - protein, 258 aa, Corynebacterium glutamicum
MLFLHLEAPFLHQRKLSRTQYLQLWRRNYPYLEVLFQHPVEHCQLQWLREVPSQLRERPHLRFLTFLQLPALLFQLRESRSRQHLVPQAVQFQHQAQQSLCLEVQLLSQHLGLVHLAQAFQAFQYQDLSPHLHQEFPHLAVHFRLLAVRPQHLAVPFRLQVRHFPFPEHLVHPEHPESQVLAFQPQVSQLPELPYQSQEHQTHLEPQAFPQLPAFKHQEFQQHQEPLPKLLLTQSQYSKMQRNDLAQMKLEMRRRNCR

SEQ ID NO: 6616 - protein, 254 aa, Corynebacterium glutamicum
MPGAAGMLGVPGASGAPGTGKEAPGVGTPGVGRPGLGIPDAPGAPGAPGTGSASPGVGRAPPGVGGALPGVGSAPPGAEIPGAGGVTDPGTGMLGTLAPGALTPGAGTGVALPGTGIAVPGVGIALPGALGAAGIEIPGAGTAAPGAAGTLGTAGADALGAGTEPPGATGVGNALPGAGIELPGTGSFAATVGGTASCSVFAGVGMAPPGAGIAFPGAGGVVEILFCGEVPSIGGVVSCCILEGAVTVCLWYLG

SEQ ID NO: 6617 - protein, 318 aa, Corynebacterium glutamicum
MVEIAQRAGRQHQEHVDTNEHDVIHHHWHVQRTSKPDGDQLIHRRIVLRPVTRHPETRHNRQRCRNKDSEEVRQLLQTVVIRPTILSRPIQRHILQTSTQRVREHIPTGWNNAHPLTRREQQNDEHRTVDDPQQIQNQVDPQRQGDLLATLFRRPITLWPAGSIDLNARLDNQHHEEHVEEVLPTQPRWNSYWRTFGVVIFTRILLDEVLQPLRGKRPFGKDHRDCSHDNCSENQDTKSHCPLLTCNWLRQPNSQRQFLLRISSFICARSFLCILEYWLCVSSSLGRGSWCCWNSWCLNAGSCGNAWGSRCVWCSWDW

SEQ ID NO: 6618 - protein, 356 aa, Corynebacterium glutamicum
MSLVVAAFGSRDGVVALTQIVGPSGSGLTRELEKRYRETPGAVMLTADPRAHITYLRATVAEELAFGLEQRGIVPAQMWERVRNIGLGLENLLDRAPAQLSGGQTRRLAIGTVAILEAPTMLLDDPLSGLDTSSRAQLITMLESYEGDVIVAAHKRWLDAPTVYLGDLEELSLPARVEFSGPSRTFSAITGTRGQQRRRWWQFNESQPQFQIGPLDITVSAGQVLWLQGPNGSGKSTLLRGLANEPGTELMLQNPSDQVIDSTVANWVPGSNSEEHPLDLSQRELRLAQCDAALGNNPEVLLADEPDVGLDVGGRNAIHQRFADFLGNGGALILTCHDETFVAEVAEYAIVKEMGL

SEQ ID NO: 6619 - protein, 214 aa, Corynebacterium glutamicum
MNPLTWIIGAFSMWIVVLGVNKLGLSIAVIIIAQVVAMIRVRNVSVLASTALLSVPALASMALIHMPYSSDGWLIALTLTARFSALMSIFLLAATAITIPELVKSLYRWPKLAYIVGSALQMIPQGKQTLALVRDANALRGRSVKGPVRAVKYVGLPLITHLLSAGAARAIPLEVAGLDRPGPRTVLVEVVEGRVEKHCRWLLPLLAVGMAWWL

SEQ ID NO: 6620 - protein, 206 aa, Corynebacterium glutamicum
MGYVAGTIALLVGVLPTLPARTIAIIPVALVLNILLGQVTGSFVIPLYLDAVGTVLVAALAGPSAGLATGALSSVVWALFNPLALPFAAGSALTGWLTGVVIKKGAFKNIFATIISGAVIGLITGAVAAPVAAFVYGGTAGVGTGAVVSLFREMGNSLLASVTWQSFISDPLDKAIVMLIVFVVVKSLPKRTTRALVPQRVPEDVA

SEQ ID NO: 6621 - protein, 272 aa, Corynebacterium glutamicum
MPSPGELLAARYGQPATWTPPQWNETLDVIHQHRSVRRWLDKPVDDDTIRTIISAAQSAGTSSNKQVISVIVVKDPELRKGLAGITRQMFPHLEQVPAVLIWLIDYSRISAVAAREDLPTGALDYLDEAALGFLDAGIAAQNAAIAAESLGLGTLYLGSVRNDAEAVQKLLGLPPEIVPVVGLEIGHADPSEPAGIKPRLPQEAIVHWDTYTEKNLELIDSYDRALDTYYSRYGQHQLWSKQTAHRAASKSITKTNRQFLRRVFERAGFGLR

SEQ ID NO: 6622 - protein, 301 aa, Corynebacterium glutamicum
MIPVLIDCDTGIDDALALIYLVALHKRGEIQLFGATTTAGNVDVKQTAINTRWVLDQCGLADIPVLAGQPEPKHVPLVTTPETHGDHGLGYINPGHVEIPEGDWKQLWKEHLSNPETKLIVTGPATNLAEFGPVENVTLMGGTYLYPGNTTPTAEWNTWVDPHGAKEAFAAAQKPITVCSLGVTEQFTLNPDILSTLINTLGSQPIAEHLPEMLRFYFEFHEVQGEGYLAQIHDLLTCMIALDKIPFSGREVTVDVEADSPLMRGTTVADIRGHWGKPANAFLVETADIEAAHAELLRAVE

SEQ ID NO: 6623 - protein, 325 aa, Corynebacterium glutamicum
MSTIEERTPGAVATEPVGHEGARVSINEKNVWSLGAGPAAFALLAMIVLMIASGVFFAQSINTLENDGGGTLAVTGLIASIVVFTVALVVTITSVKVVSPGHTLTVQFFGRYIGTLRRTGLSFVPPLSVTKKVSVRVRNFETNEAKVNDYNGNPINIAAIIVWQVADTAQASFSVEDFEEFLHQQAESALRHVATQHPYDSPVDGRVSLRGATDEVSEELADEVAQRAAVAGLEIVEARISSLSYAPEIAQAMLQRQQASAIVDAREKIVEGAVTMVETALDQLEQREIVDLDPERRAAMVSNLLVVLCSDTNAQPIVNAGSLYQ

SEQ ID NO: 6624 - protein, 196 aa, Corynebacterium glutamicum
MSSLIVGTDGLSRPSWAAQDPLMRDYYDTEWGMPIRDEQGLFERVSLEAFQSGLSWATILRKRDSFRAAFSQFDPELVAKFTDADIERLMEDAGIVRNKRKILATINNAKATLQLREKGGLVEFVWGFKPIDTPQPETLEEIPTQSPESVALSKALKKEGFSFVGPTTMFALMEAIGIVDTHLVGSHRRGSSGVWA

SEQ ID NO: 6625 - protein, 386 aa, Corynebacterium glutamicum
MIVSTQPITDRSALSAEHAEVIKATLPLVGGKINEITPVFYNKMFAAHPELIANTFNRGNQKQGDQQKALAASIATFATMLVTPDAPDPVQLLSRIGHKHVSLGITADQYDIVHEHLFAAIVEVLGAETVTAPVAEAWDAVYWIMANVLIGFENNLYASNDLEPGDVFREVTVTAKKQLSATVWEYTLAGELVAPEPGQYTSIGVVLDDGARQLRQYSLLGGSDTEYRIAVEDNGEVSGFLRDRVSVGDKIEATIAAGDLVLNKDTNPVVLISQGIGSTPMVGMLAGMNPERDVVVLHADQAESTYAQVEEVQGLVEKLPKAAFEIFYRDNDQWLEVAGRIPSGASVYLCGGVEFLKNVREQIEALDEQPRDVNFELFAPNDWLIS

SEQ ID NO: 6626 - protein, 201 aa, Corynebacterium glutamicum
MGEQFPGDKNIRVSDTERSAALAALGQFYAEGRLSLEETDDRCEAVADAKTRGDLNAIFYDLPNQQIAVVDRSEQTYTATEVAELHRKGARPRAGILGLTTVLAITGTAAFASTTAFATVLLALIPIVFIMLYVMKIGPESWHAPTPRQLQRKRMIELREKEKLRDMELKAQRKERTHALTNRALDAAETAFNTKPWKKNK

SEQ ID NO: 6627 - protein, 208 aa, Corynebacterium glutamicum
MSHTKPSIAILGAGRVGSSLARSAVAAGYEVKVAGSGAVDKIALTAEILMPGAVPSTADQAVKDADIVFLAVPLHKFRSVNPATLEGKIVIDTMNHWVPVNGELEEIDQDPRSTSEIIAEFFAGSTMVKSFNHIGYHEIEQDAGTGRAIAYATDDVDAGAQVAQLIKSFGFVPLNIGALENGRILEPGQEAFGAHLNKDSRLELVNQR

SEQ ID NO: 6628 - protein, 52 aa, Corynebacterium glutamicum
MLISGSTSIFSQPRDMEREVGLLVGGKFGTQSKAEDLAESFRTCHRIRVGNF

SEQ ID NO: 6629 - protein, 197 aa, Corynebacterium glutamicum
MVALADHLQMAVKRNELEPELTSNPNPLSAEVHHLYPEETRLATEILERTNNWLAEKGIPPLPPAEVVAISLHLVNAGFRTEDLAETYVMTGVFEQLFEVIDSSFGITLDRQSVNAARFITHMRYFFVRVHHDGQLNDGMSVLRNSLEISHPDSVACAERLSQILSLRLGAELSSDEQTYLALHVARLAEDRGTTAD

SEQ ID NO: 6630 - protein, 93 aa, Corynebacterium glutamicum
MISVAVIFWHKHLRHFGLINIFTWFFLETHTSSGQYHLGTVFHGKHNIIVEHSQPFHRSDTYLYFLGFQAFAIGGDDVAAPIKGLLLVALQDS

SEQ ID NO: 6631 - protein, 120 aa, Corynebacterium glutamicum
MSVCEAHNPENYSTGGGNIIGGVVSPTLAASEWGWQVDPLGLRIVLNNYWERWQKPLFIVENGLGAKDVLIDGPSGPTVNDDYRIKYLDDGGSGILKRYKKKSFDWCRDIIATNGESLES

SEQ ID NO: 6632 - protein, 127 aa, Corynebacterium glutamicum
MQQVAWVFATDVNIAEGIVLVGLLLGGKLIAWVRGNAITRNGNNHATDLVLWVDLMSNLSCQSTCYSIMVNSLVAVLHDSNFAFRYAFHLIIIEDGEVTAAGDPTEIVTAGLIEEVYNVKACASQTP

SEQ ID NO: 6633 - protein, 80 aa, Corynebacterium glutamicum
MATKIAHEIDPQNQIGCMIIAVPRYGITPDPRDQLTAQQKSHEDYAFGNIHVRGEYPGYLLHKFRERVSPSTSQMKTVRS

SEQ ID NO: 6634 - protein, 419 aa, Corynebacterium glutamicum
MGADQAARPTRRTTRRIFDQSEKMKDVLYEIRGPVAAEAERMELDGHNILKLNTGNPAVFGFDAPDVIMRDMIANLPTSQGYSTSKGIIPARRAVVTRYEVVPGFPHFDVDDVFLGNGVSELITMTTQALLNDGDEVLIPAPDYPLWTAATSLAGGKPVHYLCDEEDDWNPSIEDIKSKISEKTKAIVVINPNNPTGAVYPRRVLEQIVEIAREHDLLILADEIYDRILYDDAEHISLATLAPDLLCITYNGLSKAYRVAGYRAGWMVLTGPKQYARGFIEGLELLAGTRLCPNVPAQHAIQVALGGRQSIYDLTGEHGRLLEQRNMAWTKLNEIPGVSCVKPMGALYAFPKLDPNVYEIHDDTQLMLDLLRAEKILMVQGTGFNWPHHDHFRVVTLPWASQLENAIERLGNFLSTYKQ

SEQ ID NO: 6635 - protein, 100 aa, Corynebacterium glutamicum; identical to SEQ ID NO: 3704

SEQ ID NO: 6636 - protein, 401 aa, Corynebacterium glutamicum; identical to SEQ ID NO: 3705

SEQ ID NO: 6637 - protein, 419 aa, Corynebacterium glutamicum
MGKHAAETSEPKKNSPWRIGLLTFLISSVVVTLVGMVMLWPDSDDVVLADNFSQTFAGNHEQVDGTITLVDNSACNSPDTGRVFAESPTISAEPATLECVRALVDITSGANEGQKTQLITYAQPGDPEFSEGDKIRMVETPDTNGEIIYTFADYQRGPALIIWGVVLIVAMGAFAAWRGVRALVGLVVTLGIVGIFLLPGLASGHDAMWLALVCGAAILLIVVPMVHGINWKSAAALAGTLVALLLSAVLSWASIVTTNLRGLGDENHLKIINYLPEVSISGLLLASFIIGTLGVLNDVTISQASTINELAEIDEDATPWRLFTGAMSVGRDHISSMIYTLVLGYTGAALPLLLLLSLAERPLIQTLSSDVMAGELLRSGVGALTLTLAVPITTLIAAWTVPGDEPAPDDGKPRLIHRH

SEQ ID NO: 6638 - protein, 61 aa, Corynebacterium glutamicum
MPTSVTTTEEIKNVNKPMRHGEFFFGSDVSAACFPTVSPCCCHAQVSGIGRHFYPVKPNPE

SEQ ID NO: 6639 - protein, 439 aa, Corynebacterium glutamicum
MRMTVIGTGYLGATHAACMAELSHEVLGVDVDEAKIASLKDSKVPFFEPGLPEVLERNLENGRLNFTTDYAEAAAFAQVHFLGVGTPQQKGTYAADLTYVRQVVEDLVPLLEGEHIIFGKSTVPVGTAEQLQELADSLVKPGSHVEIAWNPEFLREGYAVKDTITPDRIVVGVREGATAEAIAREVYATAIAADTPFLVTDLATAELVKVSANAFLATKISFINAVAEICEQTGADVVALADAIGHDDRIGRKFLGAGLGFGGGCLPKDIRAFMARAGELGADQALTFLREVDSINMRRRDRVVQLAKEMCGGSLLGKRVTVLGAAFKPNSDDVRDSPALSVAGSLSLQGAAVSVYDPEAMDNARRVFPTLSYASSTKEALIDAHLVVLATEWQEFRDLDPEVAGGVVEKRAIIDGRNVLDVAKWKAAGWEMEALGRNL

SEQ ID NO: 6640 - protein, 189 aa, Corynebacterium glutamicum
MLLSDRDIRKSIDAGDLGIEPFDAELIQPSSVDVRMDRYFRVFNNSKYTHIDPKLNQDELTSLVEVEDGEGFVLHPGEFVLASTLEKFTLPAHLAGRLEGKSSLGRLGLLTHSTAGFIDPGFSGYITLELSNVANLPITLWPGMKVGQLALFQMSSPAETPYGSGKLGSKYQGQRGPTPSKAYLNFPNK

SEQ ID NO: 6641 - protein, 79 aa, Corynebacterium glutamicum
METTKSTHLNTRFKSPHGAIISPFTFLEKALQFSIAAENRSSAKLRTTSHRTLDDIFNFQHIPTPRNYSPLTLHILTNA

SEQ ID NO: 6642 - protein, 257 aa, Corynebacterium glutamicum
MSHKFSRRAFAVLTAAAISTSAFATTAPSAIAEPVSNVATADDSSVATSENSLDWGFKASWRTYVTGPWTGGTVDATGGATVNEDGTYNFTLGTGSNYDVDTEKGQLNYEGTVAFASDAHGFNITLSNPQITVEGDTATLSAELSDNAAPEETSTTRVDVAEFELTAPEVSETDADITYTWTDASGTFLETLQPEELSRYAGQEADALSFSITVDKASENPSDDVATGSSSSFLSTILNFLQQLASPLLKLFGSLSS

SEQ ID NO: 6643 - protein, 563 aa, Corynebacterium glutamicum
MKNSGKNSAKNRTKGILIGVLVGLIAIFAGIYAVDVFLNKDNIPRGTTVGGVSISNLSAQEARTKLETELANDVVQPVTVTAGEQSTTFDPVASGVGIDWDATIEGTGEQSWNPITRFVALFKESESPIVSTVDPAAFGPTLDRMVGELYRDPISGNLHIDAGTLVVNDTIDGQAVDRTILEQAVTENWLNPEGVKAEPYVVPAAISQDTIDKLAEGAGAKAVSSPFVVRGDDGIEGTIPVERMGEVVSFPEENGTIRVDINAEAATAMLAEGLKETEIEPTNAQISFSSGSRVVTPEVTGHGINWEETLADLPNNLTGDGPRTIDAIYEDTPATFTATDAQNATFNEVMGEFTTGGFSAASGTNIRLTAQMVDGAVVSPGDTFSLNNYTGPRGAAQGFVDSGIILNGRSDTAVGGGISQFATTLYNAYYFAGLEDITHTPHSYYISRYPAGREATIFDGAIDLQFRNNSPYPVMISTSADASNVTVRIMGVDTTSVESINNGRWSTTQPNTVRVSGSDCVPSTGAPGFTTSDTRIISDLSGNEITRETVTTVYDPSPNVVCS

SEQ ID NO: 6644 - protein, 395 aa, Corynebacterium glutamicum
MLPSFPIVRAVWKRLKPLAAAVAVAGVLLAGCAEEPEQQKAISRLSTSPSTPPAPTAEDLARAQIPEQQRDQVASLMMVGVANYDQALDALNQGVGGIFIGSWTDENLLTEPGRNIEALREAVGRDFSVSIDFEGGRVQRATNILGDFPSPRVMAQTMTPEQVEDLAEILGTGLAAHGVTVNFAPVVDVDAWGLPVVGDRSFSNDPAVAATYATAFAKGLSKVGITPVFKHFPGHGRASGDSHTQDVVTPALDELKTYDLIPYGQALSETDGAVMVGHMIVPGLGTDGVPSSIDPATYQLLRSGDYPGGVPFDGVIYTDDLSGMSAISATHSPAEAVLASLKAGADQALWIDYGSLGSAIDRVDAAVSSGEYPQEQMLASALRVQLLYITRLEQK

SEQ ID NO: 6645 - protein, 148 aa, Corynebacterium glutamicum
MTNKTMLVAFDGSPESRRALEYAAKLLQPRTVEILTAWEPLHRQAARSVSLITLGVEPEDPAHSAALKTCQEGVELAQSLGLEARAHMVESATAVWSAIVDAADELRPDVIVTGTRGISGWKSLWQSSTSDSVLHHADVPVFVVPPLD

SEQ ID NO: 6646 - protein, 67 aa, Corynebacterium glutamicum
MAYETDSLNRRTLGPAIASAVVGIAVGAVAVVGVSMISGQDTVPTGNAVTADDALLGGPEYGSREAD

SEQ ID NO: 6647 - protein, 1043 aa, Corynebacterium glutamicum
MPCSVALSMVHAKQTKKPLPRFLHSAHFYVWIVLGFVVFAQPYGQVAADTKLDLLLNPAGFLTGALHAWTDTFTLGQLQNQAYGYLFPQGFFFLITDFLPDWIAQRLWWWLVLGLGFSGFYALVARLGIGNPAFRVIAALLFALSPRTLTTLTAISSETWPIMLAPWVCLPLLSRNVDARAIALSLLPAACMGAVNATATMAALIPAALILLYRGLFLRLLLWGMGVLAVNSWWIGPLLVLGKYAPPFTEFIESSSVTTSWLNPVEILRGTTSWTPFVDTERQAGYLLVNDALFVTLSVLVAALGLIGLTLMKHRGLWAFMLAIGLLILGSAHLTAVQEFLDGPGAALRNIHKFDLLVRMPLMVGVAALGSHISLPLLGTTALTSGQGKHHTIPLPLQKRQAAGLLVVIIAVGALAPAWSARLLPQGTWDEVPDYWYEATEFLNQNATGTRTLIWPSSPFARQDWGWTRDEPAQPLLDVPWAVRDAIPLVPPEAIRGLDGLDDLGTLGTGLNDEALKRLGIGAVLVRHDLEADPDIEVDLPGEKHTFGSQGQVDVYLTDPDRNMWITSGTSKQLPTVAGGGEILSLLDTINGYSPRTLVSENAQIVTDTPQLVGTNYGDGTSSAALASLDETEVKNRIVDYPSAGPMTQVVQEGSITASSSGSDATSFGGADPDRSLNSLLDHRYNTAWYPTPGDTSPWLEVSGTGTTLSISPRSTVTATITSGDSVMVREFEKGRTTTVTLAEPEARIEFDGFVGISELSLEGLSRTITVPETSPDVQQFVFQRLTVPTSFLDRTFTVPRHMSVTVEAQSCVTLELDGDRIDCGPLELTPGTHTLRTQSEWVTLTESAPLAAVQPATNIEAAPTDRVLVTTRAFNSGTSALIDATPLSPIQLDASSQGFIIPANASGELSFAFDGEKPYKLSLFGGATIALIVVLGCVVVGRRREAINPVWQDTRNAQWAVVALIPMLGWWFVPAVASWLVLRFTLIPKWVLAGLPLAICGLWLAQAPWPAAAYPGDSPALALLAGISVAALFAGDLRPPKR

SEQ ID NO: 6648 - protein, 207 aa, Corynebacterium glutamicum
MRSPMASMNAHSPRCFIKVRPIKPRAATRTLRVTKRASLTRRYPACRSVSTKGVQLVVPRSISTGLSQEVVTEELSMNSVKGGAYLPSTNKGPIHHELTARTPIPHRSSLKKSPLYSKISAAGMSAAIVAVALTAPMHAAGSKDNAMARASTFRESRGRHTHGASMIGQVSEEIAVRVVSVRGDRANSSAAITLNAGLPIPSRATSA

SEQ ID NO: 6649 - protein, 65 aa, Corynebacterium glutamicum
MSVHSDDSRPLEAIVERVEFVTIGAPVIPVSLLIKDPPQSCGQTFKSNGFLHKTAGELQKSTTNG

SEQ ID NO: 6650 - protein, 301 aa, Corynebacterium glutamicum
MNPRWRMGAYDWVDIISTCEFSGKVWAVFMKRSATVLIIAGVLFLIFAFTVPPYVTGQARTIPKDLDLTLVSESPQGFVRTEHIVTAPTEKVDEIATHVDQTVTDVQGKTVAEISDDVVLIGHSRYPVIKPTATISGSPADSSNVVREGLHYFFPANTLRNSYPYYDIVLGEDSPVDYVSREGNTYTFYQHLRYVPLDDSHTYSVERTLKVDRFSGIIVAKDEAMTFHGPDGDDTVEFTYTADTLKLLQDHAHDIDQRLSWAKGFDFFSKFLGLSLLAIGVFLTGIFKRGQLMSTVNKLRS

SEQ ID NO: 6651 - protein, 356 aa, Corynebacterium glutamicum
MSTQSYAPIRHRGFISSLEGLRAIASLGVLATHVAFQTSVDPASNIGAVLARFDFFVAVFFALSAFVLWRRRAGQPVGLYYLKRLARIMPAYWATVIAVLLFIPTGPWLANLTMTQIYWPDGLMTGLTHLWSLCVEVAFYLVMPLLAWVLDRFGRPVRILLIVGGAVLSLAWPWIPLVEHALDEGWANMQIWPPAYACWFAVGMIAAEIEGVRFPRVPSFVWVGLALVVAWIAGQEWFGPLGLVHPSPWEFNLRVLAGTLFAVFLVVPYALGTPSRLLDSSWMKTLGTWSYSIFLWHLPVLTIVFPLLGLPLFSGNFLLVFIVTVLLTIPVAAISYTFIEEPIMRWTRRAIQAGGR

SEQ ID NO: 6652 - protein, 236 aa, Corynebacterium glutamicum
MRMILQKLQRIRSISEFYCVIAVWAMKRHRLIFSHNDAGKTIHFQGPLHRIGVRIIQWNITKMLVEGISIALARDIIHRGILTQYDVIIGIRIPQRISREEVMQPLPHHIATIRRRTRNGGSRLNHRITRVSNQHHIIRNFRNSFPLHIRNCLIHMRRDLIDLFRRSSHNMFSAHKPLRTFAHQRQIQILRNRPRLTSHIRRYREGKNEEQHARNNEDRCRSLHKNSPHLSAKLAC

SEQ ID NO: 6653 - protein, 474 aa, Corynebacterium glutamicum
MTPTRRILLWAWTTVLLGSLLWPLAAPGELLLRDMSVVDHPALSLNALGFGDLPSRNAPQDGVLALLGFLPVSWIVRTMLLVAGFAGAWGAMRLGPSKFLAVTVAIYNPFVVERLLQGHWSLVMAVWLLPLVVALRRHPRWQVVAIWAASLTPTGAVVAAVTGVASSKRKRFTTLCSFLSWLPWLIPALLATPTSGGALTFAIRSETYAGTLGTALGLGGIWNAGAVPASRELGFAVAGILLFAILLAGFKNCPWVLALLAVVGFMGAIGPWLMPNLFTWTIAYVPGAALFRDSQKLLMLAIPAYVCLAAGVKSPLSWVATGLALLQIPDAPREVSVIRPSSAHVESVEALAEIADGRDILIIGQGPLVTREDGIPVVDPKTKALSVVESGELRVDGIITDAPSQRWTEATQAWAAGDIERLEELGVGVVVDGDTITETGAPPQHGWKYYLGVGLTVLWMALPLGLLFRRKTKK

SEQ ID NO: 6654 - protein, 223 aa, Corynebacterium glutamicum
MVSRQHNKRIFIGLFSLAAFKQAIMEAMATTITVFSPTHSPAQIRETILSAAKEDDVDFLGVPFTHPRNVTIEVDDELINDCLGWLDDVALASGLGIQYNDEVLRYGDEDISFTVQTKNDDDARIGASRLGLEHQLNVIAGGSGDSGDSGDYLKIAHFDLDNPADESSYISARSLAEVDGWTLEFGVAGVKNTTIVSSIDDAITTILRWMNGEDIRDLNWTRA

SEQ ID NO: 6655 - protein, 379 aa, Corynebacterium glutamicum
MACLKAARLNNPMKILLLCWRDTTHPQGGGSERYLERVGEFLADQGHEVVFRTAGHTDAPRRSFRDGVRYSRSGGKFSVYPKAWVAMMLGRVGIGTFSKVDVVVDTQNGIPFFGKFFSGKPTVLLTHHCHKEQWPVVGRVLAKVGWLIESQIAPRAYKTAPYVTVSEPSAEELIALGVDQQRIHIVRNGVDPVPLHTPKLDRDGQHAVTLSRLVPHKQIEHAMDVVAALDGVVLDVVGSGWWQEELVDYARTLGVSDRVVFHGQVAEDHKHALLERATIHLMPSRKEGWGLAVTEAAQHGVPTIGYRSSGGLRDSVVDGETGLLVDSKAELISATKTLLIDASLRSKLGASAKQRAENYKWDTAGAQFEELLLGLASKK

SEQ ID NO: 6656 - protein, 257 aa, Corynebacterium glutamicum
MASFPELPALRRLATLGRSWGLLSDFKYEQTRPDIFYGNLALDTSSLVAALSEDISGAGLNDLKVLDVGGGPGYFAEAFETLGATYFSVEPDVGEMSAAGIDVHGSVRGSGLDLPFLPDSFDVVYSSNVAEHVSAPWELGEEMLRVTRSGGLAILSYTIWLGPFGGHETGLWEHYVGGEFARDRYTKKHGHPPKNVFGESLFNVSCREGLEWGASVGNAELVAAFPRYHPYWVWWMVKVPVLREFAVSNLVLVFKKH

SEQ ID NO: 6657 - protein, 610 aa, Corynebacterium glutamicum
MTTAAIRGLQGEAPTKNKELLNWIADAVELFQPEAVVFVDGSQAEWDRMAEDLVEAGTLIKLNEEKRPNSYLARSNPSDVARVESRTFICSEKEEDAGPTNNWAPPQAMKDEMSKHYAGSMKGRTMYVVPFCMGPISDPDPKLGVQLTDSEYVVMSMRIMTRMGIEALDKIGANGSFVRCLHSVGAPLEPGQEDVAWPCNDTKYITQFPETKEIWSYGSGYGGNAILAKKCYALRIASVMAREEGWMAEHMLILKLINPEGKAYHIAAAFPSACGKTNLAMITPTIPGWTAQVVGDDIAWLKLREDGLYAVNPENGFFGVAPGTNYASNPIAMKTMEPGNTLFTNVALTDDGDIWWEGMDGDAPAHLIDWMGNDWTPESDENAAHPNSRYCVAIDQSPAAAPEFNDWEGVKIDAILFGGRRADTVPLVTQTYDWEHGTMVGALLASGQTAASAEAKVGTLRHDPMAMLPFIGYNAGEYLQNWIDMGNKGGDKMPSIFLVNWFRRGEDGRFLWPGFGDNSRVLKWVIDRIEGHVGADETVVGHTAKAEDLDLDGLDTPIEDVKEALTAPAEQWANDVEDNAEYLTFLGPRVPAEVHSQFDALKARISAAHA

SEQ ID NO: 6658 - protein, 337 aa, Corynebacterium glutamicum
MPTPSSTKSYAAVLPPPGPSWAGSLMGISLLSSLLKIHGFPVVADFFFALAVVVAIVIIGGWLIYRSPSFKTEVMPAWAMLSMGLIALGTASPVVLGDDLWGFMFVCWSIGTAVGLVAYSLYITAILRSKAGTPTFAWGLPLVTPMVASTSAAQLHEHFELPAMLWVSFGLFLLTLASAPAVFTRVYFYYFGPKAQGIPLMATPTSWIPLGMVGQSTAAAQLIGASFGSKTAITMGIIYGIIMGIFTIPLGAIAHFVFYRAVFKGATYSPTWWASTFPVGTLSLGAHFLSQSTGVEWFNYFSLYLIALMLFHVIVSTIAGTIAVMRRIVGKLKSQLA

SEQ ID NO: 6659 - protein, 255 aa, Corynebacterium glutamicum
MSISDNSRDQLGELPAGRPLQSDFDNDLDYPRLGSVTFRRGTLTENQQTMWDEKWPELGRVLEDELIDVDAWFGREGAKTIVEIGSGTGTSTAAMAPLEADTNIVAVELYKPGLAKLMGSVVRGEIDNVRMVRGDGIEVLNRMFADGSLDGIRVYFPDPWPKARHNKRRIIQSGPLNLFAKKLKPGGVLHVATDHADYAEWINELVEVEPLLEYKGWPWEECPQLTDRQVITKFEGKGLEKDHVINEYLWQKVQN

SEQ ID NO: 6660 - protein, 235 aa, Corynebacterium glutamicum
MAEGAKLMSDVHEVIHSYNPTDKEGPESVLLVWDAPNLDMGLGAILGGRPTAAYRPRFDAIGRWLLARAGRRAHELGRHIEPEATVFANITPGGSDVVRPWVEALRNVGFAVFAKPKIGEDSDVDPDMIDHIRRRYEEGVLRGVIVASADGQNFRETLEELVAEGIPATVIGFHEHASWAVAHDTIEFVDLEEIPGVFREPLPRVSLDNLPDGGAWLQPFRPLTALLSNRHNSQE

SEQ ID NO: 6661 - protein, 772 aa, Corynebacterium glutamicum
MFSKWGHFAYRFRRIVPLVVIAAILALFVIFGTKLGDRMSQEGWDDPGSSSTAAARIELETFGRDNDGDVVLLFTAPEGTSFDDAEVFSSISGYLDGLIENNPDEVSHINSYFDTRNQNLLSKDGTQTFAALGLKGDGEQTLKDFREIEDQLHPDNLAGGVTTEVAGATAVADALDEGMAGDISRAEVFALPFVAILLLIVFGSVVAAAMPLIVGILSILGSLGILAILAGFFQVNVFAQSVVTLLGLGLAIDYGLFMVSRFREEMDKGTPVEQAVATTTATAGKTVVFSAAMVAVALSGLFVFPQAFLKSVAFGAISAVGLAALMSVTVLPSLFSMLGKNIDKWSLRRTARTARRLEDTIWYRVPAWAMRHAKAVTVGVVLLLLALTVPLTGVKFGGINETYLPPANDTRVAQERFDEAFPAFRTEPVKLVVTGADNNQLIDIYVQANEVEGLTDRFTAGATTDDGTTVLSTGIQDRSLNEQVVEQLRAISVPEGVEVQIGGTPAMEIESIEALFEKLLWMALYIVLATFILMALVFGSVILPAKAIIMTILGMGATLGILTLMFVDGVGASALNFSPGPLMSPVLVLIMAIIYGLSTDYEVFLVSRMVEARDKGESTDDAIRYGTAHTGSIITAAALIMIVVCGAFGFSEIVMMKYIAFGMIAALILDATIIRMLLVPAVMHLLRDDNWWAPGFVKKAYTVMGHGSEVEEAPRPTTRRLNDDEEVTVHEAVVAGDTVASRGGLSTQENRDLVSFVELKARLEKRRLEDLD

SEQ ID NO: 6662 - protein, 474 aa, Corynebacterium glutamicum
MHGDFLIVVEATGGWARCFLHLRAVTHDGVGLFNEAGCPPVVVAKQVHHGGDKQHADDGGIQNQRCDHAERDVLHHDDLRETKRSTDHNHDQCGRGDDRSGVCSAVSDGVVGGFAFIAGLHHARYQEHLIVGGKSVNNSHDQHQHWTHQWARGEVQCAGTHAIDEHQGENTQGGTHTQNGHDDGLRRQNHRTKYQCHEDESGQHNVESHPEELFKERLNGFDLHGWSATDLHLNALRDGNSAKLLHYLLIEGTILNTSRQHRGAIIGSRTCGETICQSLNFVGLNIDIDQLVVVRPGDHKLDRLGAEGGKRLVETLLGDAGVVSWWQIRFIDAAEFHARQRHCKSKQEQYDAHGHCLGMAHCPCRHAVPNGVFQTARCSSSATQTPLIDILTQHAEQRRQHRHRHQSSKANRGNRTECHRLQESLWENKQPGQRHSHHRCREHHSLTRGRRSGGNSLFNRGALIHFLTETRDHE

SEQ ID NO: 6663 - protein, 361 aa, Corynebacterium glutamicum
MRGFFSNPWIRWALSLAFLGVILFFLRDQLDFLKMGIQQIRHVSPVGVALTMVALVLSFVAMARVMQIMLKAGGSPATLKATTALTFAANSWSATLPGGPAFSAILTYKVQRSWGASAVLCSWFFLLSSALSTVWLVALGVIAVFYMGASLNLWSLIATFIAMVGLSGAVYWAANNPDSLARWVRKLTKNREWGFVEKLLGSIEQLRSVSLTGPQFAASTAWSLGNRLFDAISLWICIWAVTGTAPMFEPEPNNTTIAGVLLAYTTAKIAGSIQATPGGIGPIEAAYIAALVATGMTAVEAAGAVIIYRLCSFIIMAIVGWVIYFIYFTPQGLKANESLDVEQDTINSDSNRQSAIERPDT

SEQ ID NO: 6664 - protein, 121 aa, Corynebacterium glutamicum
MNRWMSLLCDSIAIGLFALFARVAHQSADMPLNVQGWFFTWLPFLAGVFIAYLVAILPAKLPSERIRPAGLTVWILAVIVGLVIWGFNNGGVPHWSFMIVATTASAILVLGWRALFKVTMR

SEQ ID NO: 6665 - protein, 516 aa, Corynebacterium glutamicum
MSNTTTAEKLADLRARLEIAKDPGSERARKKRDEEGRTTPRQRIDALLDAGSFVEIGALGRTPDEPDAPYSDGVVTGYGRIDGRPVAIYAHDKTVYGGSVGMTFGRKVSEVMDMAIRIGCPVIGIQDSGGARIQDAVTSLAMYSEIARRQLPLSGRSPQISIMLGKSAGGAVYAPVTTDFVIGVDGETEMYVTGPAVIKEVTGEQITSADLGGGAQQMQNGNISYLASSEEEALNMVKDLLDFLPLTCNDPAPVFAAPTDEEIAYDEALNSFMPDDTNQGYDMHDLLDKLFDDANLLEIQEEYAPNLITTFARVDGKAVGVVANQPMDKAGCIDADAADKGARFIRICDAYNIPIIFVVDTPGYLPGVDQEKVGLIHRGAKLAFAVVESTVPKISLIVRKAYGGAYAVMGSKNLTGDLNFAWPTAQIAVMGAAAAVVMIQGKQLEAAPPEQREYMKKLFMDFYDENMTSPYVAAERGYIDAMIEPAETRLVLRRAVRQLETKAVRDLDKKHTIMPM

SEQ ID NO: 6666 - protein, 1610 aa, Corynebacterium glutamicum
MEQSQSSDQKMTVEQVRTWLRDWVVRTTGIPVEEVTDDKAMETFGLSSRDVVVLSGELENLLDTSLDATIAYEYPTIRSLAQRLVEGEPRRAHTQRELNFSAVSDSPGSHDIAVVGMAARYPGAESLEDMWKLLVEGRDGISDLPIGRWSEYAGDEVMSRKMEEFSTIGGYLSDISSFDAEFFGLSPLEAANMDPQQRILLELTWEALEYARIAPNTLRGEAVGVFIGSSNNDYGMMIAADPAEAHPYALTGTSSAIVANRINYAFDFRGPSVNVDTACSSSLVAVHQAVRALRNGEADHAIAGGVNILASPFVTTAFAELGVISPTGKIHAFSDDADGFVRSDGAGVVVLKRVDDAIRDGDKIIGVIKGSAVNSDGHSNGLTAPNPDAQVDVLQRAYVDAQVDPTTVDYVEAHGTGTILGDPIEATALGAVLGYGRDASTPTLLGSAKSNFGHTESAAGIAGVIKVLLALQNKTLPPTVNFAGPNRYIDFDAERLEVVEDPREWPEYNGHAVAGVSAFGFGGTNAHVVISEYNAEDYETRAPKEALLPDQQVALPVSGHLPSRRRQAAADLADFLEGRKDCDLTPVARALAGRNHGRSRAVVLASTIEEAVKRLRQVAEGKVSVGISAADSPAANGPVFVYSGFGSQHRLMIKELCSISPQFRERIEELDEMVKFESGWSIMKLVLDDEQTYDTETAQVVITAIQIALTDLLASFGVKPAAVMGMSMGEIAAAYAAGGLSDRDTMLIASHRSRLMGEGEKSLAEDQLGAMAVVEFAAADLDKFIEENPEYKGIEPAVYAGPGMTTVGGPRDAVVQFVEKLESEDKFARLLNVKGAGHTSAVEPLLGELAGEIAGIEPLPLQIPLFSSVDQGVTYPVGAVVHDADYMLRCTRQSVYFQDSTEAAFAAGHNTLVEISPNPVALMGMMNTAFTVGKPDAQLLFSLKRKVPEAESLRDLLAKLYVNGANVDFSALYGEGETIDPPHITWKHQRFWTSARPSSGASLDLPGFRVNLPNNTVAFSTAAELAPSAVAIMEAAAMAVTPGSSVDAVDERDMLPPSGEITTIVTRSLGGLSLSVYKIEGTTSTLVAEGFAANPGFAAASSFDGPGYDGFNTDYSDQPDPRSDLPLDIEAVRWDPATETVEERMRAIVSEAMGYDVDDLPRELPLIDLGLDSLMGMRIKNRIENDFQIPPLQVQALRDASVADVVIMVENMVAGRSSETLVDATPQVPAEAAGEAQAAESSASGEDVQGVGVAPRDASERMVFGTWAGLTGAAAAGVTSKLPQIDVDTATAIAERLTERSGIEISTEQVLAAETLEPLSDLVREGLETEVQGNIRVLRGRAEGSTKPAVFMFHPAGGSSVVYQPLMRRLPEDVPVYGVERLEGDLADRAAAYVDDIKKYSDGFPVVLGGWSFGGAVAFEVAHQLVGSDVEVATVALLDTVQPSNPAPDTAEETRARWTRYADFAKKTYGLDFEVPFEILDTIGEDGMLSMMTDFLANTDASEHGLSAGVLEHQRASFVDNRILAKLNFADWANVEAPVILFRAERMHDGAIELEPNYAKIDQDGGWSGIVNDLEIVQLNGDHLAVVDEPEIGTVGAHLSRRIDEISRKN

SEQ ID NO: 6667 - protein, 596 aa, Corynebacterium glutamicum
MAAMGEFMYQADIAEGGGDKPRMHFWDFSEDRDGKLIQYTRNEIDTRIKAVAGRLQQVATLGDRAAILANNSPEYIFSFLGAIYAGMVPVPLYDPNEPGHADHLNAVFADSEPVVVLTNSKSAGAVRKHFSSLPAAERPRILSVDSLPDSLADSYENPMLTEAGRRLAALRQSAPIDLTAFLQYTSGSTRTPAGVVLTNRSILTNVLQIFSAAQLKTPLRLVSWLPLHHDMGIILAAFVTMLGLDNEFMNPRDFVQQPSRWIKQLNRRESDVDVNVYTVVPNFALELAARYAKPAEGETLDLSALDAIIIGSEPVTENALTTFREAFEPYGLPVQTLRPSYGLAEASLLVTTPQTENRPLISYFDREALAENRVELVEKGNNKAVAFVSNGQVAAPQQLVIVDSETGTELADGQIGEIWTHGENTAAGYLDREEDTAETFRNRLTTRLEENSRAEGAADDNYWMATGDLGVIVDNELYITGRLKDLIVVAGRNHYPQDIEYTVQAASAHIRADSVAAFAVPGDDIEKLIILAERDTTANEADDAAAEEAIRSAVGTAHGVVPEEIRILAPDEIARSSSGKIARRVNQRNYIQEQAN

SEQ ID NO: 6668 - protein, 309 aa, Corynebacterium glutamicum
MRKTITVIAVLIVLALIGVGIVQYVNTSDDSDFIGQPGEPTGTETTEPPVQPDWCPAVEVIAAPGTWESAANDDPINPTANPLSFMLSITQPLQERYSADDVKVWTLPYTAQFRNINSQNEMSYDDSRNEGTAKMNEELINTHNECPATEFIIVGFSQGAVIAGDVAAQIGSEQGVIPADSVRGVALIADGRREPGVGQFPGTFVDGIGAEVTLQPLNLLVQPIVPGATMRGGRAGGFGVLNDRVQDICAPNDAICDAPVNVGNALDRALAMVSANGVHALYATNPDVFPGTTTNAWVVDWATNLIDNG

SEQ ID NO: 6669 - protein, 166 aa, Corynebacterium glutamicum
MKRIYATLASGLLCLSLAACGGVTVEGDDSPSTTAAPTESSAGSSSTARSTERSSQASQSNGSGGSTARDGAAEEIDGLPEVTVERSAEAQAFLDALKDEKIDISGVEDQLIATARNYCSSENKDQNVTVDAVAGQLIVQGRTSVKEDQAAEISTLLKESADRTYC

SEQ ID NO: 6670 - protein, 657 aa, Corynebacterium glutamicum
MRDTAFRSIKAKAQAKRRSLWIAAGAVPTAIALTMSLAPMASAQSSNLSSDAVIGSIAQGVTDGLTDYLKPRVEELPAGEVTYPEIAGLPDGVRVISAEWATSKHVILTIQSAAMPERPIKVQLLLPRDWYSSPNREFPEIWALDGLRAIEEQSGWTIETNIEQYYADKNAIVVLPVGGESSFYSDWEGPNNGKNYQWETFLTQELAPILDKGFRSNTDRAITGISMGGTAAVNIATHHPDMFKFVGSFSGYLDTTSAGMPIAISAALADAGGYDANAMWGPVGSERWQENDPKSNVDKLKGKTIYVSSGNGADDFGKEGSVAIGPANAAGVGLEVISRMTSQTFVDRASQAGVEVVASFRPSGVHSWEYWQFEMTQAFPHIANALGMSTEDRGVECAPVGAIADAVADGAMGTCLTNEYDVTGGKAQDFANGRAYWSANTGAFGLVGRINARYSELGGPASWLGYPTSSELKTPDGRGRFVTFEHGSIYWTATTGPWEIPGDMLAAWGTQDYEKGSLGYPTGAAVEYNGGLRQQFEGGYVFRTSNNQSYWVRGEISKKYAEDGIFAQLGFPTGNEKLINGGAFQEFEKGNIYWSASTGAHVILHGDIFDAWGAKGWEQGEYGFPTSDQTAITAGGQTIDFQNGTIRQVNGRIEESR

SEQ ID NO: 6671 - protein, 467 aa, Corynebacterium glutamicum
MENRKGGENKMQEIHTIMKHMDALIADPSAAAFKATLPFAELLEKLHNKKALFDAALAKSAERADAGRIIGKTSHIDALAYLLDISKSEAFRRTKRAEEHYGNPSPEPSSEELAKETPEEKLAREEKEKQDLAEQAEANRIAREHGISAEKQDTIRYELEKLNDNTSLSRASLRKLAMQEATSRTPEDLRNWTRNKVIRINPTAKDPLAAVKKRSLSIGRQDHDGGAKASLYLDAKGLALLKSLMSKAKPGHLLEDSLAEDKRTKPQRQYDAFADILHRAHSDLLPARSGVGTILVSLSAKDVTNLKASGPDHRYPTSTGIKLTPLEILRLGAAKYDFVTVLDSESGRPLHLARTQRTASLYQRLALFASELVCTREGCDSPFEDNEIHHIRSWLDGGPTDIENITNICPHDHGNNNDQRDGKDNMGHMNIDPTTGRVGYQPADRRKPMRFNNTAAAAESGGAQART

SEQ ID NO: 6672 - protein, 73 aa, Corynebacterium glutamicum
MFSPPFLFSTQPKLQGENKGLKSYPQIRSDPRPGVKSYPQEAEGRIEKFSEMRKGGGEMLRVLRIPGVALKKV

SEQ ID NO: 6673 - protein, 341 aa, Corynebacterium glutamicum
MSVFTRAGEASRKLVALVVALATAAALMVVGQGTAQAANRDWLRADNSGYCDWDAVGFWVQRCDVWSPAMGRNIPVQIQPAGRGGNAGLYLLDGMRATEYSNAWLVDTNAARLYAPNNITLVMPVGGAGSFYADWNSQASLSSSDPVIYMWETFLTQELPAYLEQNFGVARNNNSIGGLSMGGTAALNLAAKHPDQFRQAMSWSGYLNTTAPGMQTLLRLAMLDTGGFNVNAMYGSIINPRRFENDPFWNMGGLANTDVYISAASGLWSPQDDGVRVDHRLTGSVLEFVAMTSTRIWEAKARLQGLNPTADYPMYGIHGWAQFNSQLERTQGRVLDVMNAW

SEQ ID NO: 6674 - protein, 686 aa, Corynebacterium glutamicum
MTFSPQRPEFETGKQPDPETEHAGDFFEETSSSAPRAASNGSSGPNYTLITTFLAALTAGIFAFWAGWTRKWISDDGLIVLRTVRNLLAGNGPVFNAGERVEANTSTLWQYCIYLVALVTDYRLEDIALWLALLFTTAASIIGVLGTAHLHRKRIAVLLPAGVIGYFSLSPARDFATSGLEWGLSLMWISIQWLLLVLWATSGKTSGKKASGAKTSNPIVNAGAITYALAFWSGLSWLVRPELAMYGGLTGVLLLLTAPRWRVVLGILVAALPLPAAYQIFRMGYYGLMVPHTAVAKSASDAVWGTGWEYVEDFTGPYNLWLGLALLLAAGALTVWKTDKHLAIPKGRLGLRTPGMAIALLVICALVHFLYVIRVGGDFMHGRMLLLPLFAILLPVSVIPVNVVDRGWQDLVALVLVFSTWVWSTVVFVQGHQWENTGQHVVDERDFWIDFTNRDEDHPPLYAEDFLTVDSMNDYAEVMRDQTLVNPTGQQLNILASSDPTTYSWITTPRVEGVEAGDLANLSPTVFHVNLGMTSMNAPLNVRVTDLIGLATPLAARQPRIEGGRIGHDKLMDLEWQVAESATPLAYTPGWLDTQKTYEARQALRHPELVHLFQTYREPMSYHRFVDNIKYALTTGRTLEISDNPEDLLKEFNPTPAEIQDGLETIAWPGEIKLDEPRGEPLYSSQ

SEQ ID NO: 6675 - protein, 332 aa, Corynebacterium glutamicum
MSEHAAEHHRDTQNFLTSEPHTTAIEDNKKRQPPKNLADGMIKALRPKQWVKNVLVLAAPLAAGADAIFNQRTIIDVAIAFVVFCFGASAIYLVNDARDVEADREHPTKRFRPIAAGVLPVGMAYGMAVALIALSIGLSFLATDGVALACVIGVYIALQLGYCFGWKHMPVIDIALVSSGFMLRAMAGGVAAGIELSQWFLLVAAFGSLFMASGKRYAEILLHERTGAKIRKSLESYTPTYLRFVWTMAATAVVMSYALWGFDLSQHSTDAGPWYQISMVPFTIAILRYAAGVDTGDGGAPDEVALSDKVLQVLALAWVFCIVMAVYIMPMF

SEQ ID NO: 6676 - protein, 168 aa, Corynebacterium glutamicum
MSNKEVQILVAIQDQLMDAPGVLPTARGLSLLGEHAAGWLALGAGGAVVDKKRRRSWAGLFIAALGSHAASVIIKRVVRRARPHDPAIRIGVGTPSKLSFPSSHATSTTATMVYLARITKSPVPLLGIPIMVLSRMVLGVHYPTDVLAGALLGAATAEAVHKIERATK

SEQ ID NO: 6677 - protein, 656 aa, Corynebacterium glutamicum
MSATNLAVEQLQRVLLPRRGEPADVRSLYLLEAESNKERLEWEDRFSVSVPAGAEVSFQTYFNAFPASYWRRWSQLDSVVLKLKVSGEARVDLYRSKIDGARIGITGSVVKDDFIEFEVSLAPFEDGGWIWFDLTAETDATVEEAGWYAPHAPKAQIMPDGSEVGPFEARATVGIPTFNRPADAVAALEALASDPAVDAVIDTVIMPDQGNKHPADEPGYKAAVEHFGDRFFEFRQGNLGGSGGYSRIMFEALGGVDGKGEAGAAKSPYILYMDDDIAIEPDSVLRALQVARYAKSPILVGGQMLNLQERSHLHTMGEVVGGHDFMWTAAPHVHYDHDFSAHPLHDRGKFDDKPDAPNSRDLHRRIDVDFNGWWMCMIPRVVAEQIGQPLPLFIKWDDAEYGLRARKAGFPTATWPGIAIWHMAWSDKDDAIDWQAYFHLRNRLVVAAMYHQGSVDGIVRSMQKATFKHLLCLEYSTVAIQNEAMKDFLAGPDQLFSILDTSLPRIAAIRKTYPDAVVLPSATELPRATGAPGVPTKDIGGRLAPIKKAMWLAKGLKHSLSKEDASHHEVPQANFAPIEARWFSLSRVDGATVTTADGRGVVYRKRDRDKAKELGKEARALQKQVAERFDELSRAYRNAHPELVSREAWGKVFDEQ

SEQ ID NO: 6678 - protein, 498 aa, Corynebacterium glutamicum
MLFDAPFGRYLDLVTMSVFHGFMSFIGRTVGSMQPFPLSLTNSSVAGIAAGALLFLSVPFASPVHAQTILQDTLEVTVLDNADELAPEDEDFLSTETPKIDFPDSVTAVRYITLTDNTDKINDDVENYLRAEHPEWIQTNSFAPGEVIIAVGFDPNTMGAYAGNDVAAETGIAEQDRIDGTTDAMRPLLQDGRIALGMLEGAKSVADTSVVRESSAPSGGVIAAILGGIAALVAIIVAWATSYANKKKAEKAREQFDYASRHYGEVAQQLDGINVRAHSLTSPLADDELRRQWDDVNSRFLEVNDIFGRLEGLTSTSENKAFRKALPDIEKAHTAVTQMEIAQKNIDTLYDMEHGHEDTRRRELTRLRADMQEARQDINDKDAVVDDILRTLIQRTETIAPSAPDFMDQYARLIRDYAVALQGVEKNLEQVKQTTERNAPAIYDDNWRVGTGYNSWVPYYMISSWHAADVSAASSASSSSANTTFSSGFSGAGGGSSW

SEQ ID NO: 6679 - protein, 159 aa, Corynebacterium glutamicum
MDQLILDAFIGLRVTWLSPVIILFTQLTGPTLMFVYALVWGLLRKSATAPIAVGLANLISHFLKRAFERPRPNTAEHLVVETNFSFPSGHAVGAAACAVAVGYSVNRWWKLTLWVIALLVGLSRLYVGVHWPSDVLAGWAIGALTSVVVFTSWNLLQRR

SEQ ID NO: 6680 - protein, 259 aa, Corynebacterium glutamicum
MRVPPFVILAKWVLCTFCEDLSNELAKHNFGKVPPMTENWMDPVVEPQSTGEGKSDTIWLEIVTTDQNKRSLSELAARIVSEICAPWVLNIGFFLILGGVTGAWTLGIVAAIGTGIVPMILILGLMKLGRVGNHHVTTRNQRGLVFVGIIVCVIILIFILRALEAPQLIWDGMFSALIFLVLFAQVTLKIKASVHVGLWVCLVMFLGLTVSSWWLLGLLFTPVTAWARMRIKHHTMSEIVAGVVTGAVATGICYALLLA

SEQ ID NO: 6681 - protein, 170 aa, Corynebacterium glutamicum
MRSVQFRVSSFCPWTTPISRLRPLGSGCSRSSRAEVSSVHALPLRRRTMPVHLKSADSQEKCTRVTPSPSSAGSPFSSTFRKMLDGHVLRIISAISSAPSAVVRFHVNARRSRQYPSSSKSCTTAVAASSGLELAVAFSKAWSQSLAKVVKSCSGKASSFKKCRDSLSTL

SEQ ID NO: 6682 - protein, 434 aa, Corynebacterium glutamicum
MGVTEQPYTLIIGGGQGGIALGARLKRLGVPALIIDKASRPGDQWRSRYHSLCLHDPVWYDHLPYIPFPDHWPVFTPKDKMGDWLEHYVGIMDLDYWTNTECLRASYNEDTKQWDVTVNRDGAESTLHPTQLVMATGMSGSPNKPTLPGQDKFQGEIRHSSEHPGGDVDRDKNVVVLGANNSAHDICADLYSNGAKPVMIQRSSTHIVRSDSLMREVFGPLYSEDAVEAGIDTDTADLLFASWPYKVLPGVQKQAFDKIREDDKEFYDKLENAGFLLDFGDDDSGLFLKYLRRGSGYYIDVGASELVADGKIPVRSNVSIEDVKENSVVLTDGTELPADVIVLATGYGNMNNWVAQLVDQETADKVGPCWGLGSETTKDPGPWEGELRNMWKPTNVDSLWFHGGNLHQSRHYSRYLSMQLKARYEGMNTPVYSK

SEQ ID NO: 6683 - protein, 204 aa, Corynebacterium glutamicum
MLCHLFQPCRVAVCGKAFVGVVEIAVVEVVANWQAGDVAGWEVLWISLPLLCGVVADECLVKWATNEGNGLFFEVGGVGGIDFCRLFLDELTGFIWAVVLAEELVNQAQSHGELVGGAVVHCEDAVLVAGETGELVDVFPHACVGGVEEVRAVFVDFNAGLWFCFRVSIATEVRAAFNDEDFLTQLASCTLSHGEPEEAGAYND

SEQ ID NO: 6684 - protein, 401 aa, Corynebacterium glutamicum
MTESKNYDLIVVGSGLFGLTVAERAASQLGKKVLIVERRSHLGGNAYSEAEPETGIEIHKYGAHLFHTSNTRVWEYVNQFTSFTGYQHRVFAMHNGTAYQFPMGLGLINQFFGKYYSPDEARELIKEQSAEIDSSDATNLEEKAISLIGRPLYEAFIRDYTAKQWQTDPKNLPAGNITRLPVRYNFNNRYFNDTYEGLPTDGYAAWLEKMAEHELIDVRLDTDWFDVRDDLRASNPDAPVVYTGPLDLYFNYAEGKLGWRTLDFETEVVETGDFQGTPVMNYNDADVPFTRIHEFRHFHPERDDSYPKDKTVIMREFSRFADNEDEPYYPINTPDDRDMLKQYRLLAAEEAANNKVLFGGRLGTYQYLDMHMAIGSALSMFDNKLVPFFEEGTPLEQERGH

SEQ ID NO: 6685 - protein, 683 aa, Corynebacterium glutamicum
MGASGLAAAGTQYLNTQGEGIGPVAVQNDSESFNSGTNVVVEDAAVTAQGEGGGARTVKEFQRDQQFSSFALTWTGKKDITAFVRAEQEDGTWSQWYDLEPMVNEDQGTNGTELIWHGPTNKIQVSTLNVDLFGADAAAADENGQDIPAVDAAEAAPAAEPAPAEAPVEEAPAPVAEPAPAAEPIAEPVADYSANDGLAPLPSNYGDIQPVADVDDGLNAVFIDGNADAGVGIANVADTDGMPKVISRAGWGADESLRCSNPTIDDGVSAITIHHTAGSNNYTEAQAAAQVRSAYSYHAKNLGWCDIGYQSLVDKYGNIYEGRAGGMTNAVQGAHAGGFNQNTWAISMIGDYSYNAPPQETINAVGELAGWRAKVAGFDPTGTDTHYSEGTSYAKYSYGTRVSLPNIFAHRDVGLTACPGDAGYAQMENIRQIAKAKYTSLQNGNTGGTTTTPATTPKETSTSNAPSTTTAQPVTPAEPQQYSESDALAALLTGGSSGGTDLLNGANSEQLLTGLGSIAAVLIAASLADGGLNGLISNVGSNNGVPVLGDIKITDVIPIVDTAINLTGDNKYSRGWNDLNNTLGPVLGAATGGETTVKYTSDQNSEVTFVPFENGIMVSSPEAGTHGLWGAIGDAWAQQGADLGPLGLPTSNEYTVGEQLRVDFQNGYITYDSATGQASIQLN

SEQ ID NO: 6686 - protein, 509 aa, Corynebacterium glutamicum
MRISKANAYVAAIDQGTTSTRCIFIDAQGKVVSSASKEHRQIFPQQGWVEHDPEEIWDNIRSVVSQAMVSIDITPHEVASLGVTNQRETTVVWDKHTGEPVYNAIVWQDTRTSDICLEIAGEEGQEKWLDRTGLLINSYPSGPKIKWILDNVEGARERAEKGDLLFGTMDTWVLWNLTGGVRGDDGDDAIHVTDVTNASRTLLMDLRTQQWDPELCEALDIPMSMLPEIRPSVGEFRSVRHRGTLADVPITGVLGDQQAALFGQGGFHEGAAKNTYGTGLFLLMNTGTSLKISEHGLLSTIAYQREGSAPVYALEGSVSMGGSLVQWLRDNLQLIPNAPAIENLAREVEDNGGVHVVPAFTGLFAPRWRPDARGVITGLTRFANRKHIARAVLEANAFQTREVVDAMAKDAGKALESLRVDGAMVENDLLMQMQADFLGIDVQRLEDVETTAVGVAFAAGLGSGFFKTTDEIEKLIAVKKVWNPDMSEEERERRYAEWNRAVEHSYDQA

SEQ ID NO: 6687 - protein, 278 aa, Corynebacterium glutamicum
MIALGSAPKLVASDVDGTLINSSERVPQRLRDVITRMTNQGVTLALSTGRPPRWIHYVLDQLSVKPICVCANGAVLYDSAADEILAAQTLSPEVMASAVMAARAALEEHGGVSIAVERAGKSAYDPADELFLVTPEYSHAWPSNDHGTFEEAEVLSEPATKLLMRSDYLDSKQLFDIVRASVPEDQVHVTFSMSGGLIEIAAPGVTKALGVSMLAERLKIAQKDVITFGDMPNDIEMLQWAGRGVAMGNARPEVKAVSDHITRTNDDAGVADVLEWWF

SEQ ID NO: 6688 - protein, 292 aa, Corynebacterium glutamicum
MVKRFGFFVEDSLPKVPLHPEESRETFYGRIIISAVRTVMKAQDVQISIFGAENIPTTGGALFAINHTGYYDFILGGIPAFVRGKRLVRFMAKKEIFDTPVVGTLMRWMKHVSVDRSAGAGSMEDARKRLDAGSLVGIFPEATVSRSFEIKELKTGAVRIADSANVPLLPLIIWGGQRIITKDIERDFGRSHIPVFISVGEPVDASGDPDEATERLYEAMKKLLDETRTAYEQKYGPFEGGELWRPKSLGGGAPTLEQAKMLEIAERERRQAKRAAKVAKKRTTFIRKIFKK

SEQ ID NO: 6689 - protein, 422 aa, Corynebacterium glutamicum
MIDLKFLRDNPDVVRASQITRGEDPALVDELISADESRREAIKAADDLRAEQKAFGKKIGQASPEDRPALLEGSNELKAKVKDAEAAQEAAEAKVNELQMKLSNVVSGAPAGGEDDFVVLETIGEPRTFDFEPKDHLELGESLGLIDMKRGTKVSGARFYYLTGDGAMLQLGMLMLAAQKAREAGFSMMIPPVLVRPEIMAGTGFLGDHSEEIYYLERDDMYLVGTSEVALAGYHKDEIIDLNEGPVKYAGWSSCFRREAGSYGKDTRGILRVHQFDKVEMFVYCKPEDAEDVHQQLLGMEKEMLAAIEVPYRVIDVAGGDLGASAARKFDTEAWVPTQDTYRELTSTSNCTTFQARRLQTRYRDENGKPQIAATLNGTLATTRWLVAILENNQQADGSVVVPEALRPFVGKDVLKPVKQAG

SEQ ID NO: 6690 - protein, 238 aa, Corynebacterium glutamicum
MDGLKPKHQQLREILEEICTTQLQPGDMLPGERILEEKYGVSRITVRRAIGDLVASGRLKRARGKGTFVAHSPLISRLHLASFSAEMAAQKLSATSRILSSSRGPAPDDIADFFGTDRAAQHITLRRLRLGNGRPYAIDNGWYNSEFAPDLLENDVYNSVYSILDRVYGVPVTQAEQTVTAVAADEDTARLLDVTPGAPLLRILRQSLSGDKPVEWCVSLYRTDRYSLKTLVTRSEDL

SEQ ID NO: 6691 - protein, 371 aa, Corynebacterium glutamicum
MMVSIMSTNFDTSTSPEGETKKNSSFRTAASVQTMLVAALAATAAVGVYSYNTDNSANGGESPTGPEQSTVSTTATIASFTTADVGQCATWDVNNEGLVSGFEQTSCDQEHRFEISARENLATYPSSEFGPDAAPPNLTRQAQLREELCQSPTLAYLNNRFDPSGRYTIAPILPPAEAWAAGDRTMLCGLQATDASGTPQLTVGPIAANDQARVFETGACVKVESSAEFRQVDCTEDHHLESILTVNLGVPFPQGAPSTDEQNNFLGNTCTQASIDYLGSEENVYQSTLQTFWPTITSNSWLGGSHSVNCFLMSPSTEGAATFNTLNGSATGTFTINGEVPPPQPERDPLRDTAGTTASAEVGVPVEENAP

SEQ ID NO: 6692 - protein, 114 aa, Corynebacterium glutamicum
MIEVSDERFEELVELAFDQVPQQFLDHMRNVVLLIEDFNPDSPYILGLYHGVALTERTFNHGGLPDSITIYKGALQNYCNSEEQLVEQVRVTVLHEIGHYFGLGEEDLHRLGYA

SEQ ID NO: 6693 - protein, 33 aa, Corynebacterium glutamicum
MVGLWSETTFFRLGKLLFQTKDAHFLGVLGLCT

SEQ ID NO: 6694 - protein, 223 aa, Corynebacterium glutamicum
MAGRIILLRHGQTHNNVKHLLDTRPPGAELTDLGRKQALEVGHELATYSGERLAHVYSSIVLRAQQTAVLATSTFEKARDMQSGAIPLDVVEGIQEINVGDFEMRGDEEAHMNYSRALNGWLHGDPAAGLPGGETYKDVLNRYQPTLDRIMDSHDLDDDRDVAVVSHGAVIRIVATHATGVDPNFAFNTYLGNCRFVVLEPNGKKFSQWDVVRWTDSPLPWQE

SEQ ID NO: 6695 - protein, 210 aa, Corynebacterium glutamicum
MRVRSTPRMANSLRARTRLPGTFGREKMTEVRSWPVGSETAAWAWTATKRVRAPRTSATSSTRRSSPKSSAAREGAAAASAVPSATICAPAPLELAERYMASGMVVAIQFFTCWYPTGWVARVLTSASEVPGRTMMEKAMSSSSSAMICTLEPWSRASKVGVTGPSTKFSMATTANWAVPWRTASTASCGDLAGSCSISPSPNTPASANL

SEQ ID NO: 6696 - protein, 381 aa, Corynebacterium glutamicum
MSMSVAQLANRLAQLSPAEHGFAWFDPEITAGHGVGPLHGMVIPAKDLNDVAGMPTAFGNASRRKVATDTDPFIQNLIDRGAIIAGKTQTSELGMTAYCEPIDMDAPSNPVLPGHTPGGSSGGAAVAVARSLVDAAHASDGGGSIRVPAAACGLVGFKPAHDSSGGNPSTQGFITRDVATQVRLHALQPRTRRLRIGVLAEPIHANSLVDAPFLSILESTAHLLEKAGHEIVSVPLPYGAWAFDAYTEVFMMKSAGLTNLGSPITRWLSEQGRSLSPSDRQSSVKAFDSVAETVHGAWDIDVLLTPTLAYAPPKIGYFSSMPPEEDFLAQTKWTPWATLFNMTGGAAISVPVEGVGIHLGGIRVRDEDLLGLAAFVERAVA

SEQ ID NO: 6697 - protein, 243 aa, Corynebacterium glutamicum
MSSSVMSPRRIKAEILIVLAITFGMSGLRSILRLIDDLLAPVALNDQQVALNASMANSAWLDLTLQLCSAGVLFSWGALAIYLLGERFQWIKPKDWAWGAGLAALIGIPGLIFYASAVHLGLSKQVVPTTLETWWEIPVLLIWSAANAFGEEIVVVMWFFTRLRQLKWSVPAVIVTSSVLRGSYHLYQGISAGLGNIIMGVAFAYFYHRTGKIWPLVIAHFLIDAVAFVGYSAIGGNLSWLGL

SEQ ID NO: 6698 - protein, 345 aa, Corynebacterium glutamicum
MPPRQTPPRQVPPQQQYQQPGQIGQVRPQPPVIAGDGGRRRKAISFKPRGCLGTIAGVLAVGLVLVFVVTLWADSKLNRVDATPATQVANTAGTNWLLVGSDSRQGLSDEDIERLGTGGDIGVGRTDTIMVLHMPRTGEPTLLSIPRDSYVNVPGWGMDKANAAFTVGGPELLTQTVEEATGLRIDHYAEIGMGGLANMVDAVGGVEMCPAEPMYDPLANLDIQAGCQEFDGAAALGYVRTRATALGDLDRVVRQREFFSALLSTATSPGTLLNPFRTFPMISNAVGTFTVGEGDHVWHLARLALAMRGGIVTETVPIASFADYDVGNVAIWDEAGAEALFSSMR

SEQ ID NO: 6699 - protein, 40 aa, Corynebacterium glutamicum
MLFDASPHPLQSPAAVDEPARSDQAAGTAVVGEPASVGFA

SEQ ID NO: 6700 - protein, 184 aa, Corynebacterium glutamicum
MPHVIALADGECSHRVGDHREGAERIQQRARGRSCTQQSGEEFPLTHHPVQITQGCGTSAHITQRGCPIKFLATSLNIQVRERIIHRLSRTHFHAAHGINHVRQTTHADFCIVINSQASCLLHGLRQQFRATHGKCGVCLIHAPARDIDIRITRNRQQRRLASTRHMQHHDRVRTAHTDIAAGT

SEQ ID NO: 6701 - protein, 290 aa, Corynebacterium glutamicum
MKKIHMIPAALLIGSLALVSCAPSQPTQNAQTVSSVMTETPTYTSSSRSVESTAGTIAASEEATMTLLENSSGDPGSDSGGARYSLNSLKVSEQAAANAVLKAVLNDVSYQEFADSSYLEITGTPSADGTWGISFGGPSESASVEFSDGSISFSPVDMTVPATRLPQMGAFYETLTEEQLGMLETGLAVSTVDSSQQEMLLDLVSNSIGLADTETTATAISKIRATLSETYLFGTPDGLTLALSGPHVDFEVSHQGSTAKITYRDPSTDTLTAEDRVDTASVAAAPPEVV

SEQ ID NO: 6702 - protein, 109 aa, Corynebacterium glutamicum
MSYHDHSDIEYLKKIGANSPDAFKAFVHFDEAALRGPNKKIPRNYTEMIALAVAFTTQCAYCIDIHTAAAKKEGVTTEELAEVALIAAALRAGGAMTHGALAMKLYDEN

SEQ ID NO: 6703 - protein, 438 aa, Corynebacterium glutamicum
MRSFTFILVLMRLNKRLPAALSGLLLSAALLAGCSTSGTAETTTTTVSSAAASTTTSTSSASSSSSSSSSSSSSDSSTTAETISNTAEAAQAFLSTLSTEEQDAVLYDYDAEEKSTGWSNFPVTFVQRSGVNLTDLTEEQQAAALNVLKNLLNDDAYQMIEDIMASDQYLNDESNTTEDSLGQYYIAFFGDPSSDSDWSIQFGGHHIGINTTFSDGAITFAPTHLGTQPSEWTNEDGETVAALSNMYETAFAFYDSLAEEQQAQLYQGEELDSMVCAPGSTCDYPTGTGLKGSDLTDEQKELLIDVIANWVGLADEETTETELDAIRETLDDTYINWSGATEYDTSTGDGIYFQISGPKVYIEFANQQGSAGADIDGVITAGWGHIHTIYRDPTNDYANSVTQEAASGMMGGGPGGNGGEMPSGDMPTGEMPSGAPSN

SEQ ID NO: 6704 - protein, 306 aa, Corynebacterium glutamicum
MRMAKKTKKNEQLPEGMSRRQAKLAARAAERAALEREPRPFEGLAMESQLVALQEFIPSATAPITVAGTDRKITLCTVLPGAAAALVREEAFGGEAFVAMQQAIRSNNPSKDLAFALNWVINAKAGESLATATADGTQPELKSLLNDADTLEITTHQDFNWWLAENDNLSPEVAQHMQAANDSILPSHEVEADVPGAVWWVNPGGKAHIRWVRTENETALFNALARIAARGELNLGEETKFAGAFRTHGIVVPVWDLDPERPSTDYADVLVALNEKIVAELDNDAQLNADERRQLENIKSRQVTIR

SEQ ID NO: 6705 - protein, 273 aa, Corynebacterium glutamicum
MVWRDTRVDSRYIKARRDGFMKVIAHRGLSSRFPELTESAFRAALELPIHGIETDVRLTKCGEVVNVHDPIVDRVSNGRGRVSRLDLESLLSLNFGTKETPEKVLTLNNLLDIFEDYPDKHLYIETKHPMRYAVMLEEEITKILKYRGLTEDPRIHIISFALPAMYRMARLAPQLDRIHLRRSWERWGNPRDVRCGVPTGLGLSLERAKMDPRMIGAKGLPTYLFTVDKQKDMLWAREQGVDMLATNYPDRAAELLNAHPKPAMYANAHGKED

SEQ ID NO: 6706 - protein, 463 aa, Corynebacterium glutamicum
MDTWEQTLGTGPLLGIAAGAIALILVLVIVFKLHAFLTLILVSIVTALAAGIPVTAVVDTLLDGFGKTLASVALLVGLGAMLGRLVETSGGAKSLADTMVRIFGEKRAAFALGVASLIMGFPIFFDAGLVVMLPVIFAVARRLNGSVLTFGIPAAGAFSVMHVFVPPHPGPIAASEFFGAQVGYVLIAGIIVALPTWYLTGYLLGKFLGRKFPLPVPDLLSGGAQEDDQPQNPANAVSIIVILLIPMLLIFGNTGTSMAVSAGLLDAESTMVKILGFLGETPVALLITLIIALFFLGNRRGINGSALEKTIEGALGPICSVVLITGAGGMFGGVLRTSGIGGALADSMADLGLPVIAGCFIVAAVLRVAQGSATVALTTAAALMAPAVAAADFNEFQLAAIVISTAAGSVIASHVNDSGFWLVGRLMNADVPTTLKTWTVNQTCIAIVGFVMAYAMFGLASLA

SEQ ID NO: 6707 - protein, 214 aa, Corynebacterium glutamicum
MQVWFTVQVFSVVGTSAFMSRPTSQNPESLTWLAITEPAAVEITMAASWNSLKSAAATAGAMSAAAVVSATVAEPCATRRTAATMKQPAITGSPRSAMESASAPPIPDVRSTPPNMPPAPVINTTEQIGPSAPSMVFSRAEPLMPRRLPRKNRAMIKVMSSATGVSPRNPRIFTMVDSASRRPAETAIDVPVLPKIRSIGMSKMTMIDTALAGF

SEQ ID NO: 6708 - protein, 53 aa, Corynebacterium glutamicum
MTKILKTLQFWYLCLVYLALNQPSTRQGGQESGKTQILVTHVWCEPNQGARNP

SEQ ID NO: 6709 - protein, 539 aa, Corynebacterium glutamicum
MQARLKAARNVIGAFAGEGPLYPPSDVVDAFEDADEILDEHAEILLGEPLPDTPSCIMVTLPTEAATDIELVRGFAKSGMNLARINCAHDDETVWKQMIDNVHTVAEEVGREIRVSMDLAGPKVRTGEIAPGAEVGRARVTRDETGKVLTPAKLWITAHGSEPVPAPESLPGRPALPIEVTPEWFDKLEIGSVINVPDTRGSRRAFTVTRVFDGAVLAEGPQKAYISNGTLLEHNYDRSRVYGIPAVVQRINLKVGDRLILTDEELTYDPSLGSGRTPRISCTLPQAVDAIKVGHRVLFDDGAIAAVCIDKTSTADGHNDVELEVTHARPQGVNLAAYKGINLPDSELPLPSLTEEDLQHLRFVVKYADIAAISFIRNVADVEYLLQALADIGDPVAVERLGLVLKIETIPGYEGLAQILLTGMRHENFGIMIARGDLAVELGFDRMAEVPQLIMALAEAAHVPTILATQVLENMAKNGLPSRAEITDAAMALRAECVMLNKGPHINDAIKVLTEMSRKLGASQRKSRLLLRKVKSWEE

SEQ ID NO: 6710 - protein, 314 aa, Corynebacterium glutamicum
MKETVGNKIVLIGAGDVGVAYAYALINQGMADHLAIIDIDEKKLEGNVMDLNHGVVWADSRTRVTKGTYADCEDAAMVVICAGAAQKPGETRLQLVDKNVKIMKSIVGDVMDSGFDGIFLVASNPVDILTYAVWKFSGLEWNRVIGSGTVLDSARFRYMLGELYEVAPSSVHAYIIGEHGDTELPVLSSATIAGVSLSRMLDKDPELEGRLEKIFEDTRDAAYHIIDAKGSTSYGIGMGLARITRAILQNQDVAVPVSALLHGEYGEEDIYIGTPAVVNRRGIRRVVELEITDHEMERFKHSANTLREIQKQFF

SEQ ID NO: 6711 - protein, 592 aa, Corynebacterium glutamicum
MVSLPRLASLLTTRLATLKPALKPATHLASLGAQVIAELVPGIRMSPNRRRILPANMGAGFIGAEIAMWWALSPSLLPKPWWVTAANLAVLQAVGHAAATGIHSILPRTNRRVSRKIYNATHIATGAITLTTTVVGLIRHRTQIRLIGQKNFGPKETIAGISVGTLGYGALLITGELTQHSINEVKLLIERFLPPWISFIAAVSVITLTTLTLADRVLLRRILHNSAIQAAHLNRMVFPGTEQPWEPERSGSPWSYEKWGAVGSQGRAVLSGGPRKDDIITVTRLSDTETHEPIRIFIGMVPGRSLSDQVDLVIHEMRRTGALRRDHIVINNSTGTGWITDWSAHTFEFLTGGNCVTISMQYSYLPSALSWYKDNDGPINAARMLIDAVLHELDQLPTGSRPKLFLAGESLGAYGLAEVWGDVEKLLGTADGVLLSGAPRFSDAMNALRTRRDASSSERLPVIDSGRHIRFAGEPEHLDMPATWQFPRMIVAQHASDPIVWWNAELFIRRPEWLKTPKQDHQDVFPRLRWMPFVTGWQVALDLFTSTSVPGGHGHNYHEEFIDYWAALLDREVTPELRHSIAYWIRANHIKR

SEQ ID NO: 6712 - protein, 212 aa, Corynebacterium glutamicum
MTHAILFDLDGTLVDHASAARAALHAWSPTVGVDTDVERWIELDKWGFARFERGETTHLGQRRDRIRAYLNRELDDATCDDIYSGYLKAYEQNWTAYPDAKGVLDRAVATGAPVGILTNGAAPMQQDKLDRTGLGLPELVMLAASTLDSAKPRPEMYARALTHLGARTATIIGDDWTNDVAAPRELGWNALYLDRSGTDPRADIHSLDELFH

SEQ ID NO: 6713 - protein, 181 aa, Corynebacterium glutamicum
MKIGVILGSIREGRFGQGVADWVMEQIGAYDAPDVEFELIDLKAFNVPLLESATVPGSADKQYDDPRVTAWSQAIDACDAFLFITPEYNHGVPGAFKNAYDILGNEWLNKTVGFISYGAVEGIRVVEQWRQIVATFNMYDIRSQLSFSTFTENNNGTFAPNDRRPGELIRLLDSLLTAVRD

SEQ ID NO: 6714 - protein, 231 aa, Corynebacterium glutamicum
MSVKAHESVMDWVTEELRSGRLKIGDHLPSERALSETLGVSRSSLREALRVLEALGTISTATGSGPRSGTIITAAPGQALSLSVTLQLVTNQVGHHDIYETRQLLEGWAALHSSAERGDWDVAEALLEKMDDPSLPLEDFLRFDAEFHVVISKGAENPLISTLMEALRLSVADHTVARARALPDWRATSARLQKEHRAILAALRAGESTVAATLIKEHIEGYYEETAAAEA

SEQ ID NO: 6715 - protein, 262 aa, Corynebacterium glutamicum
MSRTLWAVSDLHVTFAQNQNTVDALMPQDPGDWLIVAGDVAEKIPDVVRTLSALVKRFDTVIWVPGNHELFNRKTDRVNGKARYRALVGQLRAIGVITPEDPYPIFGGVTICPLFTLYDYSFRPLGLTAKQALAQAKIKLDDELAIAPYVDIPAWCAERVTYTEDRLKATKGPKVLVNHWPLVIEPTHRLFQKDIALWCGTTATRDWAVRFNALMAIHGHLHIPAETRVDGVSHVEVSLGYPFEKHPPHMKRPWPFPVMQIN

SEQ ID NO: 6716 - protein, 433 aa, Corynebacterium glutamicum
MTTAVDQNSPPKQQLNKRVLLGSLSGSVIEWFDFLVYGTVAALVFNKMYFPSGNEFLSTILAYASFSLTFFFRPIGGVIFAHIGDRIGRKKTLFITLMLMGGGTVAIGLLPDYNAIGIWAPILLMFLRILQGIGIGGEWGGALLLAYEYAPKKQRGLYGAVPQMGISLGMLLAAGVISLLTLMPEDQFLTWGWRIPFVGSILLVFIGLFIRNGLDETPEFKRIRDSGQQVKMPLKEVLTKYWPAVLVSIGAKAAETGPFYIFGTYIVAYATNFLNIRDNIVLLAVACAALVATIWMPLFGSFSDRVNRAVLYRICASATIVLIVPYYLVLNTGEIWALFITTVIGFGILWGSVNAILGTVIAENFAPEVRYTGATLGYQVGAALFGGTAPIIAAWLFEISGGQWWPIAVYVAACCLLSVIASFFIQRVAHQEN

SEQ ID NO: 6717 - protein, 405 aa, Corynebacterium glutamicum
MKFKKPELNGKKRRLDSALTIYDLRKIAKRRTPAAAFDYTDGAAEAELSITRAREAFENIEFHPDILKPAEHVDTTTQILGGTSSMPFGIAPTGFTRLMQTEGEIAGAGAAGAAGIPFTLSTLGTTSIEDVKATNPNGRNWFQLYVMRDREISYGLVERAAKAGFDTLMFTVDTPIAGYRIRDSRNGFSIPPQLTPSTVLNAIPRPWWWIDFLTTPTLEFASLSSTGGTVGDLLNSAMDPTISYEDLKVIREMWPGKLVVKGVQNVEDSVKLLDQGVDGLILSNHGGRQLDRAPVPFHLLPQVRKEVGSEPTIMIDTGIMNGADIVAAVAMGADFTLIGRAYLYGLMAGGREGVDRTIAILRSEITRTMALLGVSSLEELEPRHVTQLAKMVPVSDATRSAAAEI

SEQ ID NO: 6718 - protein, 135 aa, Corynebacterium glutamicum
MPIRLDGHLLVSCNRHIQSKNVEISTFNLGHLLLGEKPQTFPTPQPCVLQSTQFRGNMSDFTENTWTVHYDEDGDFPKFFNSLKEHERAAVILTIENILTPLGINICQTEWGKALGQGLYEIRIRHTVKKSQEPH

SEQ ID NO: 6719 - protein, 104 aa, Corynebacterium glutamicum
MSLKSFSSLAQSEKSTWSKEAKQDYEDASALITQELASRKALGQKLVKARKQRGVTQVQLAEASGVQQAEISKIERGLANPTFSTLESLASHLGLQFTFTESAA

SEQ ID NO: 6720 - protein, 46 aa, Corynebacterium glutamicum
MALVPEAERSTMLGEPMSKKLGIQEEIREKVQGPSEKSELASDRTE

SEQ ID NO: 6721 - protein, 237 aa, Corynebacterium glutamicum
MVVGQDDPVLVVTVCCDGVAKECDVVVDVQVVVGVQGQEECIVVLEEVVLIDLVRAWVHRVVGVVVVLVVVSIVHGQTVVAQGFWGDVCGVLVPAGVVCLITRGEDEGGSWVFDGGAFQVVCPVLDFFCTVGVGVVQLGVAEEEEVPVVTVGAGVEGLHFGPAVSFGADAVGVGGVFCEAIYGCAVDCAIAVFNVFTFSSVAGIAFGVHDADVFRNCINGDWGCEGIVQGDLCNLAG

SEQ ID NO: 6722 - protein, 539 aa, Corynebacterium glutamicum
MASRRFRMMLTASITAASLGFSLTPAIADEAVTVATAPSVGFDSGVERDAPFTAVPHDVVLGVGATQSELIFNWITAQGLTGQVAQISLDDTFASPITVDAVSENVSIVNTEGDSRDRAEGEYVEYRDGAVNRATVDSLAENTTYSYRVGSEADGWSEVQTFNTGTYGDNWNFLFFGDTQLYNTHSNRAEEVQNWANNLERATIENPGTSFILSAGDQANHSSWDEHSAYISPETLRNYRLAVNNGNHDQYNYDAYNAMYPRPNQVDENYFFEYNNALFLSLDSNDYLDIDDDIAFLRDTVAAHGDDKDWIVLTYHHSTFSQAYHMDDARIKYQRERLTPVISELNVDLVLGGHDHIYTRSHLMNGFTPVDAGREAVVGETLNPKAGEVVYLATNSSSGSKFYDFYDFQLGQRYDTGLDFQETVDQKKIRTYTAVWNQDQVQDYTNVELTPEGLTVTTKDAVSGELVDQFTLSKQDRDEESEVPVEDDKDGDNATGSSNLGLAAILAPVLAIFGFVGGLFVGGGSLAEFFANLGVKMPF

SEQ ID NO: 6723 - protein, 182 aa, Corynebacterium glutamicum
MNPFLSDTLIVQQTSSFLSNNFEIYNPDGEVVIRIKTEGSLGSRLVKGDRRFTLEDAFGTPLMQVRDPMNFVRDTYEIDDPNGNPIAHVRKRFTFFNKRMDIELPGDRVIEMHGNFLGFEFEFRMGDRIPAKVTRKWSGAGNGYLGRSTYALIFDEEAPDEIRKVIIGGMVALDLIREKERN

SEQ ID NO: 6724 - protein, 134 aa, Corynebacterium glutamicum
MISNGEGPVVALRGDIDALPMAERSGKEYAATGVTQVDNTTGQETPVAHTCGHDVHISSLLGAVQAFNSHRELWNGTLMAVFQPAEETAAGARMMADQDNAPGNHSPAFAPDMQPTLDRGVEALVVAASAWLVK

SEQ ID NO: 6725 - protein, 50 aa, Corynebacterium glutamicum
MQRQLRVLMEELVQFFAVATRVVQVGKKRDDSHASGVIRGGGMRRKAKIF

SEQ ID NO: 6726 - protein, 217 aa, Corynebacterium glutamicum
MAWFFAPEPVMVTADEALKGGRHPVLENPAPHTVLGTPVTGPWKEGQQRIWIGLGCFWGVEQMYWQMDGVEGTSVGYAGGFTPNPTYREVCSGRTGHTEIVEVVYDPSKISLEQLVARGLEAHDPTQGFRQGNDVGTQYRSAYYTENEEDAARVKAVVDAYGETLKQHGFGEITTEIGVISPSDYFLAEDYHQQYLDKNPDGYCPHHSTGIPCGVEA

SEQ ID NO: 6727 - protein, 200 aa, Corynebacterium glutamicum
MAVYELPELDYAYDALEPHIAAEIMELHHSKHHATYVAGANAALEALEKAREEGTNPDQIRALSKNLAFNLGGHTNHSVFWKNLSPNGGGEPTGELAEAINRDFGSFAKFQDHFNSAALGLQGSGWAVLGYDHISGRLVIEQLTDQQGNISVDITPVLMLDMWEHAFYLQYKNVKADYVKAVWNVFNWDDAAARFAAASK

SEQ ID NO: 6728 - protein, 308 aa, Corynebacterium glutamicum
MGNDGGDLRIDDLRSFISVAQSGHLTETAERLGIPQPTLSRRISRVEKHAGTPLFDRAGRKLVLNQRGHAFLNHASAIVAEFNSAATEIKRLMDPEKGTIRLDFMHSLGTWMVPELIRTFRAEHPNVEFQLHQAAAMLLVDRVLADETDLALVGPKPAEVGTSLGWAPLLRQRLALAVPADHRLASFSGQGELPLITAAEEPFVAMRAGFGTRLLMDALAEEAGFVPNVVFESMELTTVAGLVSAGLGVGVVPMDDPYLPTVGIVQRPLSPPAYRELGLVWRLNAGPAPAVDNFRKFVAGSRYALEEG

SEQ ID NO: 6729 - protein, 378 aa, Corynebacterium glutamicum
MLAAGLAAFNGLYCTQALLPTMTEELGITPTESALTVSATTGMLALCIVPASILSEKFGRGRVLTISLTLAIIVGLILPLVPNITALILLRGLQGALLAGTPAVAMTWLSEEIHPKDIGHAMGIYIAGNTVGGLTGRMIPAGLLEVTHWQNALLGSSIAALIFGVIMVVLLPKQRKFQPKNINLRHEISAMAAHWRNPRLALLFGTAFLGMGTFVSLYNYLGFRMIDQFGLSEVLVGAVFIMYLAGTWSSTQAGALREKIGNGSTVIFLSLTMIASMALMGINNLWVTLVALFVFTAAFFALHSSASGWIGIIATKDRAEASSMYLFCYYVGSSVIGWVSGFAFTHLPWLAFIGWLILLLCGVLAICVTLARLARNAN

SEQ ID NO: 6730 - protein, 537 aa, Corynebacterium glutamicum
MRSDSTWSSRTWHRKASRPVSIWLMVLVIAGIIHPLLPEYRWVLIHLFTLGAITNSIVVWSQHFTEKFLHLKLEESKRPAQLLKIRVLNVGIIVTIIGQMIGQWIVTSVGATIVGGALAWHAGSLASQFRSAKRGQPFASAVIAYVASACCLPFGAFAGALLSKELSGHLQERVLLTHTVINFLGFVGFAALGSLSVLFAAIWRTKIRHNFTPWSVGIMAVSLPIIVTGILLNNGYVAATGLAAYVAAWLLAMVGWGKASISNLSFSTSTSTTAPLWLVGTLVWLAVQAVMHDGELYHVEVPTIALVIGFGAQLLIGVMSYLLPSTMGGGASAVRTGTHILNTAGLFRWTLINGGLAIWLLTDNSWLRVVVSLLSIGALAVFVILLPKAVRAQRGVITKKREPITPPEEPRLNQITAGISVLALILAAFGGLNPGVAPVASSNEDVYAVTITAGDMVFIPDVIEVPAGKSLEVTMLNEDDMVHDLKFANGVQTGRVAPGDEITVTVGDISEDMDGWCTIAGHRAQGMDLEVKVAAPN

SEQ ID NO: 6731 - protein, 37 aa, Corynebacterium glutamicum
MLQVKERFLGNLCAGPDGTYIPPDHLALTVPIAFFPQ

SEQ ID NO: 6732 - protein, 507 aa, Corynebacterium glutamicum
MGRMQSERLTPSDLVGCRYRQVQRINFPEISPLPATMQRRARREVGLTEVLDRLPEQPKKRGRIPFTRADLDNDAELAEFETLEAIAAGDTLITGAVFTGTLEGVAWEVQVDVLVRNPDGSYMPVMVSNHRVARPDPHKTMQGIAVTRLGLGQPLELKATLRHHTIDGYRLTLALMGLEEAGAAPESSIGAVVGQDRDWAYLVDVTRYAPAAHRALLTPAPTAPRRVKECATCRFWPKCEPELKAADDISLFLTGDRADTYREKGINTTTALIDANLGEISHVAAAWRAEIPVLRREAHTSAPRFDVEIDVDVEAYLDLGAYLWGAWDGKTYIPFVIWSDLGEAAEGENFARFWSWLKSRRDKARQQGQTFGVFCYASNGENHWMLSTARRFFGKVKGVPDEQEIRSFISSDQWNDMFAVARSQLVGPGGLGLKQLAPAAGFHWEEEDFAGEDSLHAYLIASTAAEPEAEAARAQLLSYNGDDCRATAAVRHWLRQGARTAPVLGNI

SEQ ID NO: 6733 - protein, 211 aa, Corynebacterium glutamicum
MGIFEAIRAARAKTKAEIKAAEAKVKTEAKNKAKLDLKREKLLVQQEKNLLKVEEKGLKKRNKHELKMAKNILEQKRQGRLNKDKVKRWAGTARVLTPLLLPIIYRLSTEARDQVVKGRARRAGVTAEQLSQFAGHAAALKARIQGVRETAKNSSLPAGFVRDVEERLNELEAAANNSEFMSPQQRNRAHQSISRDLNQVSDQIQDRLLDK

SEQ ID NO: 6734 - protein, 497 aa, Corynebacterium glutamicum
MHKMCTIHIMSSSPPESATPQIKYGLLVVTLASAGITVSLAQTLVIPIIGRLPEIFNTTAANASWIITVTLLVGAVATPVMGRLADMYGKKKMMLISLVPFILGSVICAVSVDLIPMIIGRGFQGLGSGLIPLGISLMHDLLPREKAGSAIALMSSSMGIGGALGLPLAAAIAQFASWRVLFWFTALVALTVGAVIWKAIPARPRIVRSGGFDYFGALGLAMGLIALLLAVSKGSEWGWRSALTIGLFVAALVILVGWGWFETRQKSPLIDLRTTIRATVLMTNIASILIGFTMYGMNLILPQVMQLPVILGYGLGQSMLQMGIWLIPMGLGMMLISNAGAAISAAHGPRVTLTIAGVVIAVGYALTATVLFTIGNRTPGGDADNALILTTLVLFSVCSLVVGIGIGLAFGSMPALIMGAVPATEKAAANGFNSLMRSLGTTGSSAVIGAVLAGMMSGGVPTLGGFMTTLIIGCCAALVAAVISYFIPTTTTVVEAK

SEQ ID NO: 6735 - protein, 152 aa, Corynebacterium glutamicum
MSTDPIAALEYESTIFARHRNQYTGQAGTNAGVLDSSGYNLLTLLQLRGPSTIGELSAITGLDASTLNRQTKALLTKGFVERIPDPDGGIARKFHPTDLGNELLNEERTSSQEKYAELLSDWPEEDLRTFVKLLEKLNKAVETRVGKHWPRP

SEQ ID NO: 6736 - protein, 212 aa, Corynebacterium glutamicum
MIRVLLADDHEIVRLGLRAVLESAEDIEVVGEVSTAEGAVQAAQEGGIDVILMDLRFGPGVQGTQVSTGADATAAIKRNIDNPPKVLVVTNYDTDTDILGAIEAGALGYLLKDAPPSELLAAVRSAAEGDSTLSPMVANRLMTRVRTPKTSLTPRELEVLKLVAGGSSNRDIGRILFLSEATVKSHLVHIYDKLGVRSRTSAVAAAREQGLL

SEQ ID NO: 6737 - protein, 213 aa, Corynebacterium glutamicum
MFRHISDRTLSNSQKGGFSFHGQLANITVDRNHKINTQQRFCDAVKCCFQGGFRQRCRLQRRNHRASLTEIVGGCLSGKAHLLHDRLLWLLFHLSNENLLFRDMQQHLNGGESLGDRVMNFMRNTLTFRSNTRISFRHRQLGASFNQLINQFLLFIIHPPQRAERVINSHGHDRRDHRTHHTTKGQPHGILAGNRNRCRTQNRNNASHVRHHL

SEQ ID NO: 6738 - protein, 196 aa, Corynebacterium glutamicum
MRPVSDTRSRLDCMRRTLPTILAASIMLTACTPAEPEATPETTTEAAPEVITDGLPIDAMPAVERTAQTACPYLGTDWVADTNGQRVTGYGTDERFSTPSCVFYSYPEEPQLTVIVRDMATTDDAIAVVDWAAPIDSTEPAEEPAGWSGGRRGGNDTSGALYAVQNGPTAVIVFTNQDQSLKAQLIAEEVIQNLGL

SEQ ID NO: 6739 - protein, 437 aa, Corynebacterium glutamicum
MSETGRNELDVETLVKKGNQPGAMSYRNSIHILTASLLVVGLGASARLTLPMFALSCVLLFVWGFLYFYGSTKRVDLSHGMQLGWLFVLTLVWIFMVPIVPVSIYLLFPLFFLYLQVMPDVRGIIAILGATAIAIASQYSVGLTFGGVMGPVVSAIVTVAIDYAFRTLWRVNNEKQELIDQLIETRSQLAVTERNAGIAAERQRIAHEIHDTVAQGLSSIQMLLHVSEQEILVAEMEEKPKEAIVKKMRLARQTASDNLSEARAMIAALQPAALSKTSLEAALHRVTEPLLGINFVISVDGDVRQLPMKTEATLLRIAQGAIGNVAKHSEAKNCHVTLTYEDTEVRLDVVDDGVGFEPSEVSSTPAGLGHIGLTALQQRAMELHGEVIVESAYGQGTAVSAALPVEPPEGFVGAPVLADSDSSATGEVELSSPTDDE

SEQ ID NO: 6740 - protein, 50 aa, Corynebacterium glutamicum
MYSLLWHYLPGPWFVKLLIVLALIVLVFFLLMDVVFPWVSTLMPYNDVAF

SEQ ID NO: 6741 - protein, 274 aa, Corynebacterium glutamicum
MTATLSAESSRNGKKPRPRVSVSQVVGEILLTVGILALLFAYYEAYWTNVESGKLQESAGQKLDEDWNEARVNPRQKLTPELGEAFARMYVPAFGSDFNFAVIEGTDEEDLLAGPGRYVDSQMPGEAGNFAVAGHRVGKGAPFNDLGNLEVCDAIVVETYNSWDVYRVMPMSTNGADRAAEAADCFNENQVSRMAEGDYVNVSGRSITTPDRIDATYPTPGVFDTAVREGSEALLTLTTCHPQFSNAERMIVHAMLVEEIDKSSGERPAALEEN

SEQ ID NO: 6742 - protein, 434 aa, Corynebacterium glutamicum
MKCHLFGKANTIVLDILIYPVSGVMKLWHLLLHNVAGLDDSLAWFFSLFGLVITIRAIIAPFTWQMYKSGRTAAHIRPHRAALREEYKGKYDEASIRELQKRQNDLNKEYGINPLAGCVPGLIQIPIVLGLYWALLRMARPEGGLENPVFQSIGFLTPEEVESFLAGRVSNVPLPAYVSMPTEQLKYLSTTQAEVLSFVLPLFITAAILTAINMAMSMYRSFQTNDYASGFSNGMLKFMIVMSILAPIFPLSLGLTGPFPTAIALYWVSNNLWTLLQTIIMMVILERKYPLTDDFKVHHLEQRDIYRAKQKEKRIFLWTRRKNRALMILTPWNASTLHATNVELTKTRTAEINEAKQARKEIANKRRETQREMNRAAMQRLKQRRAEVKAKKKGLIDASPNEDTPSENEETKLSSPQVEPTTTAEPNREPSQED

SEQ ID NO: 6743 - protein, 213 aa, Corynebacterium glutamicum
MAASASGKSKTSAGANRRRNRPSPRQRLLDSATNLFTTEGIRVIGIDRILREADVAKASLYSLFGSKDALVIAYLENLDQLWREAWRERTVGMKDPEDKIIAFFDQCIEEEPEKDFRGSHFQNAASEYPRPETDSEKGIVAAVLEHREWCHKTLTDLLTEKNGYPGTTQANQLLVFLDGGLAGSRLVHNISPLETARDLARQLLSAPPADYSI

SEQ ID NO: 6744 - protein, 87 aa, Corynebacterium glutamicum
MLALGWITWIIIGGLAGWIASKIKGTDAQQGILLNIVVGIIGGLLGGWLLGIFGVDVAGGGLIFSFITCLIGAVILLTIVQFFTRKK

SEQ ID NO: 6745 - protein, 301 aa, Corynebacterium glutamicum
MSTEDIVVVAVDGSDASKQAVRWAANTANKRGIPLRLASSYTMPQFLYAEGMVPPQELFDDLQAEALEKINEARDIAHEVAPEIKIGHTIAEGSPIDMLLEMSPDATMIVMGSRGLGGLSGMVMGSVSGAVVSHAKCPVVVVREDSAVNEDSKYGPVVVGVDGSEVSQQATEYAFAEAEARGAELVAVHTWMDMQVQASLAGLAAAQQQWDEVERQQTDMLIERLAPLVEKYPSVTVKKIITRDRPVRALAEASENAQLLVVGSHGRGGFKGMLLGSTSRALLQSAPCPMMVVRPPEKIKK

SEQ ID NO: 6746 - protein, 329 aa, Corynebacterium glutamicum
MSSVVGEGPKPRLSVLDLVALSEGMTAGEAIAHSVRAAQIAEEHNYARFWVAEHHNSEGLASSATTLLMGHIAGHTSRIRVGSGGIMMPNHSALHVAEELGTLEAIYPGRIEAGLGRAPGTDPMTARELGRASSLVDDVLSTIVSLQNYLDTPEERPNIIAHPGINSRVPLFMLGSSLNGAAMAAKLDLPFAFASHFAPFQMGPAIASYRELAANPYVMAAANVLVCDTEEEAEFQISTLHQMFAGIVTNSRGKLAPPVRNLKDKLDPMIWKHIEDSLEMTFIGTAESVVLQLQEFADRYKLDEIITVTYSYDPEVRFRSIAALGTAWN

SEQ ID NO: 6747 - protein, 322 aa, Corynebacterium glutamicum
MKAPLPIRDGLNPSRVRLPLDAAPIRAIDFVEYLISTQRHRNPADNAEALQARFDADLVVNHYGEPYAPDTMVQPDDDIWFYRMPAAERPIPYKIHVIHEDDDILVIDKPPYLATMPRGRHITETALVKMRVLTGNNDLTPAHRLDRLTSGVLVMVKKPELRGAYQTLFARREASKTYEAIAEFVPGLLDDGPAIWESRIEKERGIVQAFVVEGPVNARTELVSVTPVEDAEQSILEEMHGPLPRQARYVLAPSTGKTHQLRIHMRDFAAPILGDPLYPVLHAVDDEDYTTPMHLIARTLTFVDPQTNEERTFVSNRPTGSL

SEQ ID NO: 6748 - protein, 91 aa, Corynebacterium glutamicum; identical to SEQ ID NO: 3587

SEQ ID NO: 6749 - protein, 47 aa, Corynebacterium glutamicum; identical to SEQ ID NO: 3586

SEQ ID NO: 6750 - protein, 69 aa, Corynebacterium glutamicum
MRMLFENSIVCHLLFLSLPQITLGDVWWVMPGGGSPILSITVNNNLIVGMILWVCLFPVKGFRPTLKAR

SEQ ID NO: 6751 - protein, 121 aa, Corynebacterium glutamicum
MTVPLYKQIASLIEDSIVDGTLSIDQRVPSTNELAAFHRINPATARNGLTLLVEAGILYKKRGIGMFVSAQAPALIRERRDAAFAATYVAPLIDESIHLGFTRARIHALLDQVAESRGLYK

SEQ ID NO: 6752 - protein, 472 aa, Corynebacterium glutamicum
MLERTQVFVDTSYLLASFYNSWETGARAQLEIDLPEVVGVLGRMIEQQLKQPVQRQMWYDGIPDSGPHRYQRALRTCDGVQLRAGQLIEWGERRTQKAVDTRLVADLVLAGVRGQCSDIVLVSGDADMIPGVQEAANAGLRVHLYGFGWDSMSSQLRHCCDTTTILDPREDFAECMQLQVLEGPLPPVVRVKPINDAEPIEDLDFTPVPGVASPFEEVSAKDEKFSPRPSEPAEALSEQVCEAQYEISKHEGQTADSGEITESFEAAEIKVTEFFGEPAAPVAESGVEAPTPEAPTVPEAAKPTPAKPKTPKAEPQKQESPKPGTPKPKAPSPADIPPKAPADTEEHSEVEAEIEDSRPKIPSPSMMAPRRKLRSRYVPLPNEVWATAGFQTPYDVGQQYASWWFENAATSTQRDQAHLLSGGGLPPEIDRPLLQFACETLHEYTLTEAQRVALRDGFHSGIRGVLLNQRDS

SEQ ID NO: 6753 - protein, 291 aa, Corynebacterium glutamicum
MANPLSKGWKYLMASFDNKIDENADPKIQIQQATEAAQKQHQQIMQHASQIIGQQKQLEMKLNRLVTDRDKLQEQARQAIQLADKSANEGDSVKAQEFNNTAEVFASQLVAVEQQLEQTTALHQQAEVAAKDAVAKSKESEMRLKEQMSQIDALRAQADQAKMQESVTKSMDSLNQFGTQDSSVPTLDAVREKIERRYADALGAQELTQNTVSDRMAEIAQSGTDMRASARLAELRAEALGTSATPKGQLEAGVEDAEELIDETSTPSATPETASPEADAPEASADESEKK

SEQ ID NO: 6754 - protein, 51 aa, Corynebacterium glutamicum
MKNHFCARKQITESDSLLRTRVYAKLHSAERSFEKMGDGSGSSSGVKVVRP

SEQ ID NO: 6755 - protein, 484 aa, Corynebacterium glutamicum
MRSYLNPCPQKPDARSSISICSHRTVPRSKSSAVGLKYRGAASTTSATDTNKMPVQRCIHAPAPRSPPGEHTMNPSPVSCWPSAHRLKAQGWEYGPISIRFEGIATGELTAPIPSVSTIACLLRAAGAVESNPKKRPKSSVVRFQRGQAMEMWQIDGFIYTLHDSDLTRVTIYQILDDATRFDVGTCVFPANENSVDARTVLEQAIAHFGAPHELLSDNGSAFNRMRQGYVGSLESYLATVGCLSITGKPGHPQTQGKNERGHRTLFRFLQAHQPHTLEECAHYIEQFRDHCNNRRPHQGLPNNLTPAAAWEIVGCVEQQPPIDPVVLQQQADHYARRRIEKQSDVSLVRQEESVPVSKMQQTEQRRRVRRFGKKPVDPDVFTFAGNNQKVVFQGMRISVPRTMRDREFYRTVTATELGFWDAITGELELLISLPVVAIARGKSYISSYNIRGVWMQHPTLLWQRKRDEAEKRFKSIDPGDLLR

SEQ ID NO: 6756 - protein, 356 aa, Corynebacterium glutamicum
MVRQTLRRPPGCTFPALHRHGVDDGLCHHARRPGFLVHGDYNMVHMVFGDMNTDRAAQAYIIVITTIVMVVLFWIVLSYWSLADRARAQRFTASITEIGRKIFLNRLRPRMSRQNTYTDKDISQFHWTNGLPPTDDESPEWIAARDNEWEGYTITLGDDPNGTEKTITLDDLRELPQTSYVAVHTCMQGWSATARWTGVRLRDVLCHDLVHTLDLHHRHSPRLLTIEIIPKPLPPETRCKIIDFDLFAPNSPSIEEFCSRLKISRRSFYNIRNRYQQDASAALHPRSSAQITSRRTYDESITSILLAIRAPPESPRMGIRSDLYPIRRHRHRGTDCTDSIRLNYRLLVTRCRSSRK

SEQ ID NO: 6757 - protein, 83 aa, Corynebacterium glutamicum
MQMLGYTFVIFILAPFLILTGIAMAPAIRSRFPWYVKLFGGHQGARSLHFIAMVLMTGFVIMHVGLVFWSMATTTWSTWSSAI

SEQ ID NO: 6758 - protein, 103 aa, Corynebacterium glutamicum
MAPGHQMQTAQGGRVYTSLMDEKSLSPLIGLPGRENIGLGRHWHGLSTMLRVLNGIVYVVLLFATGLWQGIIPTSWDVFPEAWETLKVYLGFRAPGIEHFTPL

SEQ ID NO: 6759 - protein, 237 aa, Corynebacterium glutamicum
MSSYRPLESRLAGTSRATADNRTPCTGRLGTPRVFLMATDDVSKAYSSPTFDAEALLGTVISAEDPDRVLIEPWATGVDGVILDVGSGTGRWTGHLASLGHQIEGLEPATRLVELARQTHPSVTFHHGTITDLSDSPKRWAGLLAWYSLIHMGPGELPDALVALRMAVEDGGGLLMSFFSGPSLEPMYHPVATAYRWPLPELAQALETAGFQVTSSHWDPRFPHAYLTAEASKQNLA

SEQ ID NO: 6760 - protein, 240 aa, Corynebacterium glutamicum
MIISTNTAHPLHEPHVPSHHNRMNTLRAGVLGANDGIVSIAALLLGVIATGASDTVVFGAGLASTIAGAVSMALGEYVSVSSQRDTERVLIAKEAKELAEDPTAEHVELSEILHSYGISPETANQAATEIGQGDALGAHLQLELGIDNEQLTSPLAAAFSSAVAFLLGALLPMVSVFIAPAGWDAGVVFVVTLLVLAVTGFISAQISGTSPMRACGRLVIGGALGLALTYGVGVLFGAAV

SEQ ID NO: 6761 - protein, 68 aa, Corynebacterium glutamicum
MNYSWRSRGEGEPDLLRHDVDSLKLWVCHDLVPDISGNDEAVSRAHTTVFGRELNDASPLGDDEHRFG

SEQ ID NO: 6762 - protein, 126 aa, Corynebacterium glutamicum
MGDRHLGLTSFYPFPGFLDVVRGEGAFAALVLAGLFRQAIPSAWRSRMMERSNSAKEPRMLSMSWARKALDSAEKIRFSLMKCTLAPLVVIWSMIFCRSTFDHHNDRPGTTIGTRDMKHRSQVLLV

SEQ ID NO: 6763 - protein, 62 aa, Corynebacterium glutamicum
MALPDDGAFELSEGAENAQHELGPQSIGFRREDQVFLDEVHARTLGGDLVNDLLQVDLRPSQ

SEQ ID NO: 6764 - protein, 72 aa, Corynebacterium glutamicum
MHFIKENLIFSAESNALRAQLMLSILGSFAEFERSIIRERQAEGIAWRKRPASTRAANAPSPRTTSRKPGNG

SEQ ID NO: 6765 - protein, 161 aa, Corynebacterium glutamicum
MGNIIFVEDGFNRADGLAGTAVDALIGVDVEHPFALVDAVHGTFLDAGSIQDINAGLGDCVGHRISNTTDKDVENRFTVILLAPRPFTKGHIFSIIPATSSGKDSGTGQLVTVACWYKHQGQEAGDRTVPVHGLAAEDGPSAGSNTPGEVPIFLIASVWQW

SEQ ID NO: 6766 - protein, 107 aa, Corynebacterium glutamicum
MTYTIAQPCVDVLDRACVEECPVDCIYEGKRMLYIHPDECVDCGACEPVCPVEAIFYEDDVPHEWWDYTGANAAFFDDLGSPGGAASLGPQDFDAQLVAVLPPQNQN

SEQ ID NO: 6767 - protein, 111 aa, Corynebacterium glutamicum
MHKISIEALARKQLKEAVAAPSARAADTVFGGHEKILRQTVVGIRQGAELGERDNHDESTIYVLQGRVQLRTGDETWIGRSGDLLIVPRSRHSLEAIEDSAVLITIAKLTQ

SEQ ID NO: 6768 - protein, 37 aa, Corynebacterium glutamicum
MTSAGRAGRSHHDSHRWVQTYAPELDKQTRWYRQVPD

SEQ ID NO: 6769 - protein, 54 aa, Corynebacterium glutamicum
MPVDHTTILTAGSRHTPLSWTSKHGGTGRYLTSRPVPGGWIRPTSGYGVIGNRW

SEQ ID NO: 6770 - protein, 346 aa, Corynebacterium glutamicum
MSSVIGGDVADPEEFHVLLGSHRVGYTFTDDTVPVYCNLDFIRHADCPSRKSWFGPMVVWSCFSSGVVGECPCSELVEHLLHLGDLGLLIFNDLLSQSDGLRVLAISDLIAGHIDRALMVGGHLLKVEPGSLGALGVLEGCHVLLAHHSTHPAMVHLTHITGDRIFFPGLEHGIHPVDLRALGIDNTLGELDDLGRDIVLGQEDFTHLHGLLVMRDHHLREHDVRIIVLGGDLSGRPRLCLRIRGGPGRFGGVGGGRSGDGRGVGVFSLSVICAGGQNQGGGQGESGDGDSALHGGSLSEVVYGGVDEGLKVSGRGLQSSQQPSPPSRRSELGEPGPGRSGVAAGR

SEQ ID NO: 6771 - protein, 42 aa, Corynebacterium glutamicum
MPNKIKVAVNGYGVIGKRVADAVRAQEDMELLGVSDVTTDYR

SEQ ID NO: 6772 - protein, 220 aa, Corynebacterium glutamicum
MKRTITIAALALTSTLVLSACADNTEGENTDTTTIATTSAPDTTETTGATTDPETETGAAGEVSAEHNDADIMFAQMMIPHHQQAVEMSEILLAKDDIPAEVIEFTQGVIDAQGPEIDRMNTMLETWEEDPVTGDMGEMDHGGMSGMMSEEDMTALEDAQGTEAARLYLEQMTAHHEGAVDMARDEVTDGQNPQAIALAEQVIEDQEAEIAEMEQMLNEL

SEQ ID NO: 6773 - protein, 739 aa, Corynebacterium glutamicum
MSTPHHHGDHPAPETDHTHHPNHAGHEHHADAATHGQAMPHDHPHSTVDEEHQVHSHGEHAGHSAAMFRDRFWWSLILSVPVVFFSPMFADLLGYNIPEIPGAYWIPPVLGTIIFLYGGTPFLKGAMTELKSRQPGMMLLIAMAITVAFIASWVTTLGLGGFHLDFWWELALLVTIMLLGHWLEMRALGAASSALDALAALLPDEAEKVVDGTTRTVAISELAVDDVVLVRAGARVPADGTIIDGAAEFDEAMITGESRPVYRDTGETVVAGTVATDNTVRIRVEATGGDTALAGIQRMVADAQASSSRAQALADRAAAFLFWFALITALITAVVWTIIGSPDDAVVRAVTVLIIACPHALGLAIPLVIAISSERAAKSGVLIKDRMALEHMRTIDVVLFDKTGTLTEGAHAVTGVAPATGIAEGELLALAAAAEADSEHPVARAIVTAAAAHPEASQRQLRATGFTAASGRGIRATVDGAEILVGGPNMLREFNLTTPGELADITGSWAQRGAGVLHVVRDGEIIGAVAVEDKIRPESRAAVRALQARGVKVAMITGDATQVAQAVGKDLGIDEVFAEVLPQDKDTKVTQLQERGLSVAMVGDGVNDAPALARAEVGIAIGAGTDVAMESAGVVLASDDPRAVLSMIELSHASYRKMVQNLVWATGYNIVAVPLAAGVLAPIGVLLPPAAAAILMSLSTIIVALNAQLLRRIDLDPAHLAPTDGKEEKAAVSSAAPVR

SEQ ID NO: 6774 - protein, 57 aa, Corynebacterium glutamicum
MGGETPPDPPIPQERSDDHPDFPLAAAGLRRLWMLRALYTVRDRLRLGRGRGNRRNT

SEQ ID NO: 6775 - protein, 64 aa, Corynebacterium glutamicum
MEQIPEPFLRQVQIDPVFLGPGDIVDVFHQPGQAGELVSHDRVGGIIPVHDPVLETIEVDREHR

SEQ ID NO: 6776 - protein, 399 aa, Corynebacterium glutamicum
MNHRPGLTFRFLAAQVLVVVISLLVAAAVATMVGPTLFHDHMLMTGREDPSLELFHAEQAYRDANLITLAVALPTALISALLASLWLSRRLRTPLQDLTRAATSLTAGNYRIRVPAGEAGPEVTTLAHAFNTMADRLEHTEQVRRQMLSDLAHEMGTPLSVLTVYLDGLQDGVVDWNNATHTIMADQLTRLTRLMEDIDDVSRAQEHRIDLDLAEEGLGDLLHTAAAAAGEAYADKGVDLQVETIMDTVRVLVDRQRFGQVMSNLLSNALRYTPAGGQVRISVHRQGASTALIHVADDGEGIPPGQLGHIFERFYRGDAARSRDNGGAGIGLTISKALIEAHGGTLTATSPGPGAGSVFTIRLPLHQENVSLMLSDPTPGDNNSDDLGSDPYQPLDNTP

SEQ ID NO: 6777 - protein, 276 aa, Corynebacterium glutamicum
MDIDDAFIADPGGVPDLGDQVVAGQHLAGAQGQGNQQLELRAGELHGRLPHPHLMGDGVKDEVTNDQGGGHLRWGGAGARAAQHRMHPGHQFPDAKRFGDVVIRPQGQTADLVVLAATRGEHEDVAVREGADPSAHLQAVEFGQPQIQHHNIGGKATGLVHGLGAGVRLAGVEAGPDEVGGHHLSQGLFIIDDQHPPRGRGGGRCAVSHRPQYRFGRGEYHPRSVPGGEIFIKSSNITLRPPSPLCPTPGRRHRLPWSVQQASPGISLPAPHTRGG

SEQ ID NO: 6778 - protein, 252 aa, Corynebacterium glutamicum
MVFPPAEAILGSMADRTPTTATPPGRVLVVDDEQPLAQMVASYLIRAGFDTRQAHTGTQAVDEARRFSPDVVVLDLGLPELDGLEVCRRIRTFSDCYILMLTARGSEDDKISGLTLGADDYITKPFSIRELVTRVHAVLRRPRTSTTPPQVTTPLIVGDLILDPVAHQVWVGETTVELTRTEFELLVALALRPGQVLTRHDLITEVWDTTWVGDERIVDVHIGNLRRKLGTDTRGRGFIDTVRGVGYRVGQP

SEQ ID NO: 6779 - protein, 224 aa, Corynebacterium glutamicum
MISGPSGTRARKGMASTLRRCLLTVLPRSKEIDVKRAAIAAAALTLALTGCSAADPEPTADGTVSQDTFLTTHGLAAMDAVEIIDHLDRQKVTERPTDLIASVRADELLLSSDDQEVVVDLPDNQTYVSIAPYLTSTHDCFYHSLTTCLGELDNEDIQVTITDEATGEVLIDEQTTTFDNGFVGFWLPDDATGTIEITHQGRTGVTEFSTTEDGATCVTDLRLT

SEQ ID NO: 6780 - protein, 493 aa, Corynebacterium glutamicum
MTSSFSRRQFLLGGLVLAGTGAVAACTSDPGPAASAPGPSLRPTPTPTALGEPTVRRTLTARPLSLDIGGIEAKTWGYVSDTGDAAIEATAGDVLQVDITNELPESTSIHWHGIALHNAADGVPGMTQDPIEPGESFSYVFEVPHGGTYFYHSHTGLQLDRGLHAPLIIRDPQDAEDQDVEWTIVLDDWVDGIQGTPDDELDKLTGMGSGDHNGRMGMGGHGQMMHGTPDRVLGGDVGDVMYPHYLINGRIPRAHRTFEARPGDKARLRFINSGGDTIFKVALGGHRMTVTHTDGFPVQPWETESIYLSMGERVDVEVILGDGIFPLTALAVGKDDRAFAVIRTAGGQAPRPDVDFPELSSTGLLLSSLKPADRALLPEGTPDREVSIDLGGQMMPYEWSILTDGQSSSATVQEGQRLRMVMRNRTMMPHPMHIHGHTWALPGSGGLRKDTVLLRHGETMIADLIADNPGEWAFHCHNAYHMETGMVSSLRYE

SEQ ID NO: 6781 - protein, 121 aa, Corynebacterium glutamicum
MEEGEEISLSDFEGEVVVLNAWGQWCAPCRAEVDDLQLVQETLDPLGGTVLGINVRDYNQTIAQDFKLDNAVTYPSIYDPPFRIAAALGGVPTSVIPTTIVLDRSHRPAAVFLREVTALSG

SEQ ID NO: 6782 - protein, 306 aa, Corynebacterium glutamicum
MSKVYVSNEYGGPENQELITRNTPQPGPGELGVKVHAAGVNPLDWKVRSGVAGTPRELPAPLGEEASGIVTAVGDGVEGFAVGDPVLGLVAPGVGGYAEDTLLVAESTVLKPEEISFTDAAAIPVAGASAYAGTHQVELEPGQSLLINGAGGGVGLMAAQIGRVHKFQVVGVDHEDKRELIESTGAIFVATGDAVAEQVRALLPDGVDVVFDLVGGEALRVVAPLAKNPAHVISAADAATVGELGGQVLRRTPEMVGQITGVVQYGLVDPKVDTTYPLEQAGKALAHVEQGHARGKIVLELITSQD

SEQ ID NO: 6783 - protein, 157 aa, Corynebacterium glutamicum
MNPLSKVVACSETSTAPVPSSMISNSWAIETTCALYLPVEALAEVVDAYPQLALAIMRMQQDQLVRSRERETAQTTSTVEQRVAAALQHLDAKLGQIRQDGSSLLQVRLRRDDVAGTTVESASRAMARMKKTGVIDSGREWIAITNHQALADLVAGL

SEQ ID NO: 6784 - protein, 78 aa, Corynebacterium glutamicum
MTAPATLKNTTLRSDEFTCPSCVAKIENKLNGLDGVENAEVKFSSGRILITHDPQKVSVRDLVTAVAEVGYTAKPSAI

SEQ ID NO: 6785 - protein, 105 aa, Corynebacterium glutamicum
MAEVTFASLHEKMNFLLKDHGVENFDESDLDLESVSSLHAKANALCAAHGGDPSRMANDTLAQLHPKLDFLMKGHGVDTDTARLDLSTLEAVDAKVNAVVNAHDH

SEQ ID NO: 6786 - protein, 69 aa, Corynebacterium glutamicum
MTLIKLGQFRRNFLDLDQSPTHLRPDEVEQKSMPRGLSTPGTHQHRTVLVGSWRGDDVASIMLLSRVLG

SEQ ID NO: 6787 - protein, 625 aa, Corynebacterium glutamicum
MKTWKTWGIVAVSGLLIILSWLTPAGWLSDGFMIAAAVVAGWQIALSAVQALRIRMISIDLLVIVAAIGALFINNYWESAAVTFLFALGKALEKATMNRTRKALSDLVDAAPETATVLRDGEPETVEIWELAPGDVVLVKNGEQIPVDGRVLSGHGGVDEATITGESVPAEKAADSEVFAGTWLRSGVLRIEAIGIGSDSTLAKIIHRVEDAQDDKAKTQTFLEKFSKYYTPGVMIAALAVGLITLNVELALTLLVIACPGALVISIPVSIVAGIGRSAKDGVLIKGGEYLETSAKVDTVVVDKTGTLTNGRPELTNVDVLDPAYSDDEVLTLAARAETASEHPLAEAIIRGAENRGLTVAMVEKAEPVAGRGIRADVDGATVAVGSADLLDHTPDNTRILELNEQGRTAMYVGINGKAVGIVAVADTIRDDAPAAIRSLHNKGIRVVMATGDAERVARNVAAELGVDEVRAELMPEDKLEIVKELQAQGRVVAMVGDGVNDTPALATADIGVAMGAAGSPAAIETADIALMADKLPRLPYALGLAQRTVRTMRVNIGIALLTVTILLAGVLLGGVTMSIGMLVHEASVLLVIAIAMLLLRPTLKEDKDKADVSTADAAKETLSA

SEQ ID NO: 6788 - protein, 130 aa, Corynebacterium glutamicum
MILARVESEPMPIASMRSTPERSQVPAKTSESAAFSAGTDSPVMVASSTPPCPESTRPSTGICSPFFTSTTSPGASSQISTVSGSPSRSTVAVSGAASTRSDSALRVRFIVAFSSALPRAKRKVTAADSQ

SEQ ID NO: 6789 - protein, 103 aa, Corynebacterium glutamicum
MSASPPSLSTSDMQMSKFLNAPFGPRIRFSRPWSPSRMLLRYFTYRCSTVGGQIPSDFNSVIALAREGALSVLITLGYPADALDLRALARKRFAAATFRFGER

SEQ ID NO: 6790 - protein, 72 aa, Corynebacterium glutamicum
MKYLNNILEGDHGRLKRILGPKGAFKNLDICISDVERDGGDALIAERARHDVCPHGQPNPDAVIVNRVFETA

SEQ ID NO: 6791 - protein, 86 aa, Corynebacterium glutamicum
MRPISGSAAGGATSDLAITAGGQTLDFYLSPKRNVAAAKRFLAKALRSNASAGYPRVINTDKAPSLARAITELKSEGICPPTVEHR

SEQ ID NO: 6792 - protein, 53 aa, Corynebacterium glutamicum
MPVDHTMIYRWVQKYAPELDKQTRWYRQVPDWQASSWRVDETYIRVGGRWCYL

SEQ ID NO: 6793 - protein, 149 aa, Corynebacterium glutamicum
MAGNNYSPLKVGLYIDLTNLERRFLMATIDVTEETFESTVTGDGIVLVDAWASWCGPCRQFAPTYEKVSETHTDATFAKLDTEANQGLAAALQIQSIPTLMVFRDGIMVYREAGTMPAPALDDLVNQVKALDMDDVRRQVAEQQGSAEA

SEQ ID NO: 6794 - protein, 88 aa, Corynebacterium glutamicum
MDGGHVSESAGFHHIGRKRILSTKNYHVEGLTCANGVASVEDEIGIVAGTQGVDIDIETGRVTVTGEGFTDEEIIEAVANAGYKVSGR

SEQ ID NO: 6795 - protein, 448 aa, Corynebacterium glutamicum
MSQRVIFSGMNLTRNDRLDRLPVTSKHKKILGGSGIGWALDAMDVGLISFVMAALATHWGLSPTETSLLGSIGFVGMAIGASLGGLLADKLGRRQVFALSLLVYGVATGASALSVSLAMLMALRFVVGLGLGAELPVASTLISEFSPRKVRGRMVVILEAFWALGWIMAAIVGTFVVAGSDNGWRWALALGCVPAIYAVYVRLGLPESVRFLEKKGRHDEAEAIVVSFEEAAAAEGKAADATTAVVHDNAAEGSVSIWSAALRKRTVALWIVWFCINLSYYGAFIWIPSLLVADGFTLVKSFQFTLIITLAQLPGYAVAAWLIEKWGRRSTLATFLVGSAISAALYGLANVEWQILVAGCLLSFFNLGAWGALYAIGPELYPTNVRGTGTGAAAGFGRIASIIAPLIVPPVIAFGGPIALFALFATAFAIAAIAAFTLPEQKGKSLAD

SEQ ID NO: 6796 - protein, 53 aa, Corynebacterium glutamicum
MNLVDHADPENSGEGRAGVMLNGTLKGTDMDIITAGDPDVVAVDVLAEAICAM

SEQ ID NO: 6797 - protein, 192 aa, Corynebacterium glutamicum
MHFEELNNESCGSRGSGEFRGRPGRRHAQRHAEGHGHGHHHGRRPGRGRGGRAGRGDLRNVILVLLEAESMHGYQIITTISEQTEGNWTPSPGTIYPTLSMLEDEGLISISHEMGRKMARLTEEGAQEVAKNKDAWGSILEAYRNPESREVRVFNIRSEFHKVREAAKAAPDDKAEQIIEILRRAADDIKRL

SEQ ID NO: 6798 - protein, 510 aa, Corynebacterium glutamicum
MATDTHAASFDDDYVPPQEPSDSFADDAHVDVPAPAFEDFSPAQAFGQGTRGGDSQGFKKRGRKDESREYRDFRQPPYDNDAEMGVLGAMLLSPTTVIDILDILTPEDFYRPSHQLIFQAIIDLFSDNRDIDPVIVSGRLDRTNDLDRVGGGAYLHDLIQSVPTAANARYYAEIVSEKAVLRRLVDAGTRVVQLGYEGDEGAEIDAVIDRAQQEVFAVSQKNQSEDYAVLADILDETMAELEMLNDGGIATGIPTGFKDLDDLTNGLRGGQMIIVAARPGVGKSTIALDFMRSASIKNNMASVIFSLEMSKSEIVMRLLSAETEIRLADMRGGKMDETAWEKMVQKLDKVAQAPLFIDDSANLTMMEIRSKARKLKQKHDLKMIVVDYLQLMSSGKRVESRQQEVSEFSRQLKLLAKELDVPLIAISQLNRGPESRTDKRPQLADLRESGSLEQDADIVMLLYRPDSQDKDDERAGEADIILAKHRGGPIDTVQVAHQLHYSRFVDMARG

SEQ ID NO: 6799 - protein, 172 aa, Corynebacterium glutamicum
MSLRCDDLKLHAGNNSVGELCFYLVLTGGLNQVLRENNGTLVQVRAAGCLDCVDDVVSLNGAEQFSALGGADCNGNTFKCFQCYLNFASVVEVANLASLLGTLDALDLLLSTRGGYDCQATGEQQVTSVAVLNLYDVASDTKVFNGGGEDQLHDPCLSWFLSVCECFRKEKL

SEQ ID NO: 6800 - protein, 150 aa, Corynebacterium glutamicum
MKLILTAAVENLGVAGDIVEVKNGYGRNLLLPRGLAIVATPGAEKQIEGIKRAQEAREIRDLDHAREVKVALEALEGVTIAVRTSESGKLFGSVKTDDIVDAVKAAGGPNLDKRAIVLPKNLVKTTGKYQVEAKLTDGIVSRVKFEVVAA

SEQ ID NO: 6801 - protein, 225 aa, Corynebacterium glutamicum
MAIGDTNITVVGNIVADPELRFTPSGAAVANFRIASTPRSFNRQTNQWEDGEALFLTVNVWRQAAENVAESLSKGMRVIVTGRLKQRSYETREGEKRSVFEVEADEVGPSLTFAKADVQRTPRGGNSGGNYGGGNQGGGLGGNQGNQQGGFSNQNSGGFGGNQGNQQQSNQGGFGGNQNQSQGNNFNQGGFGGGSPQAAPDNDPWNSAPPAGSGGFGGADDEPPF

SEQ ID NO: 6802 - protein, 95 aa, Corynebacterium glutamicum
MRQYELMIILDPSQDERTVAPSLDKFLEVVRKDKGDVVKVDVWGKRRLAYPIDKKEEGVYAVVDLKCESATVLELDRVLNLNDGVLRTKVLRLDK

SEQ ID NO: 6803 - protein, 63 aa, Corynebacterium glutamicum
MSTTVLLVTMVSVFVGFLCFGGAFASFMYKKSNKQIWTLFSIAIVLITVIPVTIAVFWATTPA

SEQ ID NO: 6804 - protein, 486 aa, Corynebacterium glutamicum
MDQKLDQQKVDRVSPGDSEPVARDFINAIGGRFGRFAQVGTQRFWTPLRVLITTSLVFLAMGFLTKANCIQGSRGTDGVVSLNWSGSRQYTSACYNDIVPLYGGRGIDAPGFPYAFSWQEGDLTRYMEYPVLGGIFQWICGIITRFLYPVVDVIPFHTLPESGLYFIVTALALAFFWVLVIRMMVELTGNRVWDTVLVAASPLVAVHAFTNWDTPAIAAVIGAMLAVKRGNPLVAGVLIGAGTAFKLWPLYLLGAYLVLAVKNKNLKPFITMAAAAAVTWLVVNVPVMIAYPKAWNEFLRLNRERGAEWTTIYQVIDRNLPINLNDPVLLNVLSFGLFGASCVAILILGLKVQRTPRVAELAFLIVAAFLLFNKVWSPQYSLWLVPLAVLAFPQWKVLFPWMVTDAMVWPILMWHMLGTDNKGLPHEMLDLIVISRDAFIVVMIVGVIRQMLGRRADPVMDAHAGRDLLAGPFGAGERRKALKEVS

SEQ ID NO: 6805 - protein, 294 aa, Corynebacterium glutamicum
MQQRLLDGTGTTTAATDVSDLSITHSHRRRAVWLRQWNTLLKCCCQTKDLECRTGLKRSVCKVPTSRILAAVISTNRTIRRINGDYRCTVVLRQKIQLVLYRFNGTFLSLWINGGGDLQTTGLHIILSDTKLRQLRHHLVLNQTISAGGFGVRTVGRRVSGFRVGSNCALLCRDSANFHQAVHDIVPTRFRLNWICPRIQLAWQLNTGRQHCALSSRELFYWLIKECMSCSLHTIGISTEVHSVEISLKDLVLRPLIGHLRGIDQFLSLTDQRTLITNHSLLHILLSNGGTTTR

SEQ ID NO: 6806 - protein, 720 aa, Corynebacterium glutamicum
MTNSKNPPAKKSSGKRRLKSDSKGYAVRNTIIGAIVAVILIPVMVFMGAYIMVDVPEPEELVSPQVSQIYASDGETELARIVPPEGNRQMVTIDQVPDTVKNAVVAAEDREFYTNPGFSITGYARAALGVITGDSSAGGGSTITQQYVKKAVVGDERSLIRKAKELVYSAKMANEWSKDEVLEAYLNTVYFGRNAYGVQAAAHAFFDKPVEELTAAEGAVLAASIQLPSQLDPWTNPVEAETRWNYVMDGLVEIGAISAEERAVATYPETTDPASNSAYTEATGTNGLIKNQVMAELSELGITEDDVQTRGLQVTTTIDPKTQEGAVEAVQNQLDLLSENNRAAVVSIDPSNGAVRAYYGGEDATGWDFANAPLQTGSTFKIFGLAAALQQGIPLSQPYSSAPVTVGDAQIGNVGGSGCGSCSIEQALLHSYNTSFIRLQQDLENGSQDTADMAHALGIAKSLPTIPETLTENGETPYEGIILGQYESRPLDMASAMATIANEGVWHRPHFVSKVETVSGEVLYEFEDGDGERRVSEKVALNLLKAMGPIAAYSNGNALADGQVSASKTGTTQLGDTGANKDAWMLGAAPQLATAVWVGTADNTALYNTWGGSMYGSNSPATIWKQTMDNALENSPLETWDIAPALGYGNPPVPEYVWTPSPNIATNDPEGATEEAPVEDPNAVIDTPAVDPTAPAEETGNGQVEILPGLTIPGDLLGIG

SEQ ID NO: 6807 - protein, 119 aa, Corynebacterium glutamicum
MQYQNEISHQLARRQTLRQFRAGLVQKDTICDAEFILVTASKYHGHLADYPCPICGSEDLRVVLWVYGDEIGRAAGSARSEEEIEQLVKNGRQATVHTVEVCPTCKWNHLLKAETATAS

SEQ ID NO: 6808 - protein, 157 aa, Corynebacterium glutamicum
MLAGMPNLNAEELAVRVRPALTKLYVLYFRRSVNSDLSGPQLTILSRLEENGPSRISRIAELEDIRMPTASNALHQLEQLNLVERIRDTKDRRGVQVQLTDHGREELERVNNERNAEMARLLEMLTPEQLERTEDLVDIITELAEVYGSWKETDSGS

SEQ ID NO: 6809 - protein, 314 aa, Corynebacterium glutamicum
MMKQPLRVLISCRPEENSGGKRSEQNDAVFEFAAWLARTSDINVRGITTFIRPWPSSSISKLGGKYHKWYKNLDSYYRSRTIKGLKEAGVEKSQWDDDVSVFVDGPSESTLLTHAAEEFEADLILLGSDATAPKGRFLASSTADALLHSSPVPLGLVPRGVKLSKKGVTRVNYAFTNESDDFEQGLRSSAELATNWNVPLRILAFSPTGITSAPTSRSLDISTELSSEWRELTLAMLDRARDGVLTDHPNLSVSSETGSGWGWSGAIDALRWKKGDLLCMGSHRTDTLSRVFVGSETMEIIRNSPVPTIIYPGL

SEQ ID NO: 6810 - protein, 165 aa, Corynebacterium glutamicum
MPAKEDNFMNTQPEHPENDLVDEADFSNRPRIYSDDPDSLADAPDPALEHEKNKKSSRQALIYLFAVPLVTFVSAYVLAWVSRLQGGPICDAGEAVWICSRAAELWWPITTSVIAFGGMLGSAWILYDKYRNYLRWRPWMGVLWILIPFSMLWGTSVLTLSILGH

SEQ ID NO: 6811 - protein, 107 aa, Corynebacterium glutamicum
MSIVKINAISVPEGAGEELEKRFAARQNAVDSAPGFEGFQLLRPVSGEDRYFVVTQWADEDSYNAWRDAEKAKGGHGQGAHGSDKKPVASGASLLEFEVVLGSTGAK

SEQ ID NO: 6812 - protein, 312 aa, Corynebacterium glutamicum
MATSKILLYYAFTPLSDPKAVQLWQRELCESLNLRGRILISTHGINGTVGGDIDDCKAYIKKTREYPGFNRMQFKWSEGGAEDFPKLSVKVRDEIVAFGAPDELKVDENGVVGGGVHLKPQQVNELVEARGDEVVFFDGRNAMEAQIGKFKDAVVPDVETTHDFIAEIESGKYDDLKDKPVVTYCTGGIRCEILSSLMINRGFKEVYQIDGGIVRYGEQFGNKGLWEGSLYVFDKRMHMEFGEDYKEVGHCIHCDTPTNKFEHCLNEDDCRELVLMCPDCFANVETRHCKRERCAAIAADFAEQGIDPLVTS

SEQ ID NO: 6813 - protein, 421 aa, Corynebacterium glutamicum
MSLAESILLALTSLRSNKMRALLTLLGVIIGIASVIGILTIGKALQDQTLNSLESLGANDLSAQVEERPDEDSPEPDMFAFSGAANSSGNLIPEETVDTLRDRFAGSITGISVGGMGTQGTLIGDTADLKSDLLGVNEDYMWMNGVEMNYGRAITQDDVAAQRPVAVIAPDTFNTLFDANPNLALGSEVAFELNGQETFLRVIGVYKEAAAGGLVGSNPTVHTYTPYTVANDITHTEDGLNTLSIRAAQGVDQDSLKGSLQTYFDALYANNDSHHVAMLDFRKQIEEFNTILGAMSLGISAIGGISLLVGGIGVMNIMLVSVTERTREIGVRKALGARRRDIRLQFVVEAMIICFIGGILGVLLGGILGLIMSSAIGYISLPPLSGIVIALVFSMAIGLFFGYYPANKAAKLDPIDALRYE

SEQ ID NO: 6814 - protein, 230 aa, Corynebacterium glutamicum
MSLIEMRNIVKTYNIGSEGELTVLHGVDFHVDRGEFVSVVGTSGSGKSTMMNIIGLLDKPTDGTYTLDGVDVLDISDDALASHRAKSIGFVFQNFNLIGRIDALKNVEMPMMYAGIPAKQRRSRAVELLEMVGMGERLNHEPNELSGGQKQRVAIARALANDPEIILADEPTGALDSATGRMVMDIFHQLNKEQGKTIVFITHNPELADESDRVVTMVDGRIIGSEVKHS

SEQ ID NO: 6815 - protein, 659 aa, Corynebacterium glutamicum
MSVPWHFGYRLVVRTYERSAPGLPDPRGHLTVALPPSLSLAPKKLIIVAVVLILIIAAASFYFLRSSSNDQVIATSDVREISSEGIVARVSVNGNIEAARTTTIYTSLTVPVANLPVAVGDRVAADQVLAELDASALQRQLDETDANNARAAMANRNSIAQSQQAYEQSRELLDSGLSPEINSARSSLRASSQAYQDAIRSFEAKQRDVDGGLDSTMVAQSDALKAAREQADAAEIERLRADFGLLNNDRSNLNDVIGLLDERESLASAESELAQARAAGDLEAVAAAEAKVAGLEQSIASKTSTWPSQDQTYLQSYTALEEAERRVASTTEALEIAERIYIDSLGKVDSELAAAQRAVAEAHSAQQDAALGLETAQLSTQHQLEAQSSAIDAALGLASVDNEAATRSTSQLRMDINNTTVRSPYSGIVSSVQAAQGQPAAGALLSVADDSELKITANVKEAEISNVTIGSRVTFTTPSTGTKEFAGRVSKVSPIAAAASAPATGEGAAAGATTTNTDVTFPIEISVTGDREGLNLGGSARVRIVHEIAPHVLTVPLEAVYKNDDGKDAVLIISDDNKVEEVEVKTAESDDFDIAVSGAGISEDARVLTQPGNYRGLIGETVKLHADTVEQAAAPFSPAAPFDPAAPAVSAKQTVGQVI

SEQ ID NO: 6816 - protein, 363 aa, Corynebacterium glutamicum
MSTSTIRVAIAGVGNCATSLIQGVEYYRNADPSETVPGLMHVKFGDYHVGDIEFVAAFDVDAEKVGIDLADATEASQNCTIKIADVPQTGINVLRGPTLDGLGDHYRATIDESTAEPVDVVQALIDAKADVLVSYLPVGSEEADKFYAQAAIDAGCAFVNALPVFIASDPEWAKKFTDAGIPIVGDDIKSQIGATITHRVLARLFEERGVRVDRTMQLNVGGNMDFKNMLDRNRLESKKVSKTQAVTSNIPDGPLSGKVEDRNVHIGPSDHVQWLDDRKWAYVRLEGTAFGGVPLNLEYKLEVWDSPNSAGIIIDAVRAAKIALDRGIGGPIMPASSYLMKSPPEQLPDDVARERLEAFIIEA

SEQ ID NO: 6817 - protein, 202 aa, Corynebacterium glutamicum
MSSSFRLFSGRVLIEMYKVKLMKLKWIAPILPVLALAGCGNYVNVESQGKSGISHDEDGNISVHMYICGDNAVDELILSGGFYDGPPGTNNPALGMLKTSNPESGYVVVNIADPAPWEVVEPINLPTEQGKYIIANPRLVDKGWPIPFAKEKYMPSVSTSVGMLEGIDPGLVMRDMYTESTHVFGTAEDFVEAGQQWCEDYF

SEQ ID NO: 6818 - protein, 495 aa, Corynebacterium glutamicum
MSIGFDRDLYIKMQSQHINERREQIGGKLYLEMGGKLFDDMHASRVLPGFTPDNKIAMLTELKDELEILVAINAKDLERKKTRADLDISYEEDVLRLIDVFRELGFLAEHVVLTQLEDDNYQALAFKQRLERLGLKVAVHRVIPGYPTDARRIVSEEGFGINEYVETTRNLVVVTAPGPGSGKLATCLSQIYGDHQRGIKSGYAKFETFPIWNLPLEHPVNLAYEAATADLDDINIIDPFHLAAYDTKATSYNRDVEVFPLLKTMLEMLSGSSPYKSPTDMGVNMVGSAIIDDAACQEAARQEIVRRYFKALVDERREEQDDTISARIAIVMSKAGCTVEDRRVVARALDVEESTGAPGCAIELNDGRLVTGKTSELLGCSAAMVLNALKELAGIDRSVDLLSPESIEPIQSLKTQHLGSRNPRLHTDEVLIALSVSAANSETARRALDELKNLRGCDVHTTTILGSVDEGIFRNLGVLVTSEPKYQRKALYRKR

SEQ ID NO: 6819 - protein, 165 aa, Corynebacterium glutamicum
MANYTVPGINENDAKQLIDGLQERLTDYNDLHLILKHVHWNVTGPNFIAVHEMLDPQVDLVRGYADEVAERISTLGGAPVGTPEGHVADRTPLQYERNAGNVQAHLTDLNRVYTQVLTGVRESMASAGPVDPVTEDIYISQAAELEKFQWFIRAHIVDVDGNIQE

SEQ ID NO: 6820 - protein, 271 aa, Corynebacterium glutamicum
MIMPEGHVIHRLAGELTKNFGDTILDATSPQGRFTSEAAIINGHRIAVAEAYGKHLFVEFDADHPEHILYIHLGLIGTLQFEPAEETRGQIRLHLSDGEIAANLRGPQWCRLITDAERTQAIGKLGADPIRDDADPEPIRIKVQRSGRSIGSLLMDQKLFAGVGNIYRAETLFRLGISPFTIGKDITTAQFRSIWADLVGLMKDGVVTGRIDTVRPEHTPEAMGRPPRKDDHGGEVYTYRRTGQECFLCATPIKEQVMEGRNLFWCPGCQR

SEQ ID NO: 6821 - protein, 383 aa, Corynebacterium glutamicum
MNHVVNFASHLEDAALKQAEATATMPFIYPHVALMPDAHFGLGSSVGTVFGTKGAIIPAAVGVDIGCGMIGVCTNYTASDLEGRDLVTLRDYIERVIPLSPGNYNSTTLKETAKVKVAELEELAERDGVDLSHSPTWKRQLGSLGGGNHFIELCLDELDRVWMFLHSGSRGVGNKIAQKHIKIAQAECKNEELPDKDLAYLTEGTEEFESYIKELNWAQRFAFLNREEMMDRFARELGFFVDKQLEEVERINCHHNYTVQEEHYGETIWLTRKGAVLADEGTPALIPGSMGTASYVVSGKGNAEALRSAPHGAGRRMSRNQAKKRFSTADLDSRMAGIVYRPGKEWIDEIPDAYKDIDQVMADAADLVTIRHKLRQIVNVKGT

SEQ ID NO: 6822 - protein, 363 aa, Corynebacterium glutamicum
MANCHQIGSIGHHLIDVFVSVGNFIDPLLAGPVDDARHPRIQVGRREALFSLVARHPPARPMRRRPQCLGVALATDHVRRGAHRPRNQRRRAFVRQHGTLTGEPNGLAVVLLLDRVVMVAVDALDLFKLLVDEKTQLPCESVHHFFPVEERKTLRPIQFLDVRLKLLSPLGQVRKILIGKLLILTLGLRDLDVLLGNLVTHTAGTRVQKHPHPIQLIKTQLNEVITSTKRTQLALPRRRVRQIYTIALREFLQLRDLHLRGFLQGGGIVISRRQRNHPLDVIPKRHQITSLQVRGRVIGTHSYHSATYIHTHSRRNDRTLGAEHRSHRRTQPKVSIRHQRHMRVNKRHGGSSFGLLQGCVFQM

SEQ ID NO: 6823 - protein, 191 aa, Corynebacterium glutamicum
MWIVLKIRRLLLRRVLPLLITLALLCGLVLAWFIYPAKAEPKKVDVVLVLAGSSDGRHEYGAELVEEGYASNYVVSNPSGSKDKVGYAHCAGKSRPKNAESFCMDPYPVITSGEARTFNELAKKEGWESVLVVTSRTHTQRVRTMFDQCYTGDSTVLNVNSLGRTGLHNAVLHEIGGFIKFWITAPCADTN

SEQ ID NO: 6824 - protein, 158 aa, Corynebacterium glutamicum
MHHLRYESPIGELLLVASDQGLTYVAFSDENYAACTVGSTPGTNAVLEQAVAELEEYFAGKRKEFSTPLDWPSQNLLSFRGKVQEFLLSIPYGESKTYKQIAAELNNVGAVRAVGSACATNPLPIFAPCHRVLRTDGALGGYRGGLEAKQWLLELERP

SEQ ID NO: 6825 - protein, 337 aa, Corynebacterium glutamicum
MSAQMDTPDPTMSAVAMLDSIPSDQPDFLIDVEVDRPTPGPHDLLVHIEAVSINPVDTKVRMRAGKQKHPKILGFDAAGEVVAVGSQVTLFNVGDKVFYAGSNQRPGSNAEYQVVDERLVGHAPQSLGAHDAAALPLVALTAWESLFDRLGVTQSTTGTLLVLGGSGGVPSALIQLARALTGLKVVATASRPESQEWVTKLGAHEVIDHSKDLSEQISDVDFVFSSWTTGREVELATLMKPQSHLVLIDDPVDPNLGAFKQKAIALHWEFMFTRAMFNTPDMGEQGKILNKIADMVDRGQFESVTATVLDGLNAANIMEGHRLVEQGKTSGKIVVRV

SEQ ID NO: 6826 - protein, 37 aa, Corynebacterium glutamicum
MPEILLKASLKALPKALPRALPGALLKASQASGKTSP

SEQ ID NO: 6827 - protein, 392 aa, Corynebacterium glutamicum
MSTTTAPEARFPVVPLTAMSFAAFVYVTFEMFAVGLIKPMASDLGVSESSIGLLMTVYATVVAVVTIPAMLWVSRFNKRTVFLITLAFLATGIVVQALTVNYGMLAIGRTIAALTHGVFWALVGPMAARMSPGHTGRAVGVVSIGSTMALVVGSPLATWIGELIGWRPATWILGALTIAAVAVLIPTVPSLPPLPDTESESKEKKSLPWGLISLVIFLLLAVTGVFAAYTYLGLIIAETAGDSFVSIGLFAFGALGLIGVTVATRTVDQRMLRGSVHTTTLFVIAAILGQIAFGLEGTLAVVAIFLAVTVFGGAYGALPTLGTTIFLHAGRDHPDTASSIYVVTYQVGIASGAALGAMAVDADWVAGTLWIMAGLSLASTLALALWSRPLLK

SEQ ID NO: 6828 - protein, 392 aa, Corynebacterium glutamicum
MTIDLQRSTQNLTHEEIFEAHEGGKLSISSTRPLRDMRDLSLAYTPGVAQVCEAIKEDPEVARTHTGIGNTVAVISDGTAVLGLGDIGPQASLPVMEGKAQLFSSFAGLKAIPIVLDVHDVDALVETIAAIAPSFGAINLEDISAPRCFEVERRLIERLDIPVMHDDQHGTAVVILAALRNSLKLLDRKIEDLKIVISGAGAAGVAAVDMLTNAGATDIVVLDSRGIIHDSREDLSPVKAALAEKTNPRGISGGINEAFTGADLFIGVSGGNIGEDALKLMAPEPILFTLANPTPEIDPELSQKYGAIVATGRSDLPNQINNVLAFPGIFAGALAAKAKKITPEMKLAAAEAIADIAAEDLEVGRIVPTALDPRVAPAVKAAVQAVAEAQNA

SEQ ID NO: 6829 - protein, 494 aa, Corynebacterium glutamicum
MGSIPTMSIPFDDSRGPYVLAMDIGSTASRGGLYDASGCPIKGTKQRESHEFTTGEGVSTIDADQVVSEITSVINGILNAADHHNIKDQIAAVALDSFASSLILVDGEGNALTPCITYADSRSAQYVEQLRAEIDEEAYHGRTGVCLHTSYHPSRLLWLKTEFEEEFNKAKYVMTIGEYVYFKLAGITGMATSIAAWSGILDAHTGELDLTILEHIGVDPALFGEIRNPDEPATDAKVVDKKWKHLEEIPWFHAIPDGWPSNIGPGAVDSKTVAVAAATSGAMRVILPSVPEQIPSGLWCYRVSRDQCIVGGALNDVGRAVTWLERTIIKPENLDEVLIREPLEGTPAVLPFFSGERSIGWAASAQATITNIQEQTGPEHLWRGVFEALALSYQRVWEHMGKAGAAPERVIASGRVSTDHPEFLAMLSDALDTPVIPLEMKRATLRGTALIVLEQLEPGGTRATPPFGTTHQPRFAHHYSKARELFDALYLKLV

SEQ ID NO: 6830 - protein, 197 aa, Corynebacterium glutamicum
MRAPSTSMIALALIAYSAVMVSLTMLKSFFVIGLLWVPEAHRNRSISLVPFNDFIESSSWFSPLFGYGGNFAFFVPFGVLFYVLLKTSGSWHKNSVIHTMRVGALFSLAIEISQYVFMLGYSDIDDLIFNTLGAGAGALIAKIFGERFFKVWVWLALILAVVFAVLVALGPRLGDPDKVVDLGEAQQLSNTPMHVFA

SEQ ID NO: 6831 - protein, 175 aa, Corynebacterium glutamicum
MKKSFNASSLLFAFSFGVYLVLLVMMTLLKSRLSLGGLWNTEAHQYRSIDLELFNGFADPPIWWGPWTNTFGNIALFMPFGFFLYKMLRRFNHRFPFVETILFASVTSLSIEVLQWVFAIGYSDVDDLLFNTIGGLIGASVAALVSLKSSKVVSGIIMGGSLSVMAMMMYSSFIA

SEQ ID NO: 6832 - protein, 448 aa, Corynebacterium glutamicum
MPESILGRMDTKLGAELGTEFDLIVVGFGKAGKTIAMKRSAAGDKVALIEQSPQMYGGTCINVGCIPTKKLLFETATGKDFPDAVVARDQLIGKLNAKNLAMATDKGVTVIDGKATFTASHEITVTSGSDTLVLYAPTIVINTGSTPVIPNVPGTDNPHVFDSTGIQHISPLPKHLAIIGGGPIGLEFATLFSGQGSKVTIIDRGELPLKNFDREVAELAKTDLEARGITFLNNAELTGFSGDLTIALKDHDLLADAALLAIGRRPATDGLGLEQAGIKTGTRGEVLVDAHLRTNIDGIFAVGDVNGGPQFTYVSYDDHRIVLDQLAGTGKKSTAHRLIPTTTFIEPPLSTIGDNTEGENVVVKKALIADMPIVPRPEIINQPHGMVKFFVDKQSDALLGATLYCADSQELINTVALAMRHGVTASELGDGIYTHPATSEIFNQLLGS

SEQ ID NO: 6833 - protein, 410 aa, Corynebacterium glutamicum
MSSSGKVIVVGAGIVGLATAWHLQEHGFEVSVLDRDGVAAGSSWGNAGWLAPAKTIPLSEPGLWTYGPKELFNPVSPMHMPLRVDPKLWLFLAQFMAQAFQRKWDSTMADLTEIDKVALEAFDELSIGGVEGLTHEGPFVIGFEEERQSAGFRKEIDGVSRHGQKVEMSRLENPQELAPMLNEQIQVAYRLEGQRFIEPGPYVQSLADAVVKRGGVIRAGAEVVHVAKGDRPAVILADGSREEADKVVVATGAWLPGLTREYGVKTLVQAGRGYSFSVATDIPAKHSVYLPHHRMACTPYEGRFRIAGTMEFRGPDEPFQQGRVDAIVSQAKKVMRGIDFNDRQDEWVGSRPVTPDGRPLIGQTKAENIYVAGGHGMWGVVLGPATGKYLAELMATGNTNPIIKPFDPLR

SEQ ID NO: 6834 - protein, 501 aa, Corynebacterium glutamicum
MPEGQSGTIVLVSDGIATCTPPPVCEVAAELADQGVDLVINTVGFNVDESARAELECIAQAGNGTYADASDADSLVAELKRAATRTAVGYESDLEQIDGNSSQTSLTPIPDDVELFKADLPALDNKDGEVTQYWSIPVEDYERVQVTTSYVAPVTFGLGNDYLSIRNELLFGDEQDQTCHRSISNDQILDNYGARPLVASVESDVIGDKCDTDELVLAITRSQPFNWEEELPVEIVVKRLNHADTSGLPLGDQQREIPDLDVAAVQTWAPTTGGSWFTNATELTPGEGVEAEIVPGENHVYRLPMATGQQLHGFVEVVENTAPDDPGVTDKLGVAVYSPTRQDAGVDMWTDIAPREGTSEYFAAPVALTYLNMFPAEGGFGTTSKATSTFTFEGDYYLVVHYDDLSGSTIRDASNQQSFPLRYRLAADAFGDAEPGPVFEKVSATTSESSSPSTQPDEPAQNTATEESSTGISPLIVGAIVALILAFAAFASWLVLKGRKK

SEQ ID NO: 6835 - protein, 110 aa, Corynebacterium glutamicum
MFIVHLAGQSTRQRQTIFLAVITSILLIVLSVPSTANAQTESTSRGVPTMLVLDSSGSMVTPDAGGQSRSDAAKEATNQFIDELAGTLDLGLVTYGGNTGETPEDYEAGC

SEQ ID NO: 6836 - protein, 107 aa, Corynebacterium glutamicum
MRKLRTASVALLTAGALALTATPAMAQSTTGSSASSQVGDALGASDYERDIWGSSKDFDDVTPFGSAWYGYTLAATAVAISGLVYANLPAIEQAAAQAGIKLEIPRY

SEQ ID NO: 6837 - protein, 203 aa, Corynebacterium glutamicum
MTTVTQDLLALDEDAQNLLFREARTANAFTDEPISDEQIEAIFDLVKWAPTAMNSQPLRVVIVRSEEAKARLVPLMAEGNQAKVAAAPAVALLAADIDFHEEMPKLFPPFPGARDMFEADEASRASSAELNAGLQIGYAIIGIRAAGLAAGPMTGMDADAISKEFFPDGRHRVLVAINMGKPADNAWYDRLPRLEQDEVVETL

SEQ ID NO: 6838 - protein, 308 aa, Corynebacterium glutamicum
MNRTLRTLGWLAAVIQEDPEPWFTTDPDTDYVPYVNSFSFESLSLVPDALMLLKRSLHLAMEQQDLPVKDLQEALRHVLVFKFHFREEWELELAWDSERTKSAVRIIESTKESLADQYRDYKYAFLPELIFQESRGIFDFELEGYTLKVGQSTLSIPWDMIANGYVPASLRNFGELMDRDTGDLDADPILRPRELKFEIHNCPDLNPWIMRETFDFMMEIATETGWFHALNPAYNSVYTYDLISRMPDFLVEGSFRPHSVKRSWEKIQKIAKAVESYASHDYCMSTLTHDYRAIELSLTPTKTEEPST

SEQ ID NO: 6839 - protein, 484 aa, Corynebacterium glutamicum
MCLAVFVVDDWERLAPVTLASEQPVAQLVLDGAAAKFLFFQPFDGLGNSLILGKAVDIQAVVVRRVDCFARFGESSLFDVATCDNFLDRQTQNGGEFVVALVVSRNRHDGAGAVAGQNVVSDEHCDLIAVDWVGRVNAQEDAGLFLVFLTLQVGLRGDGGAVCSDSFRRARLAIGPTGINALVGTSLLQQHVDQLMLRCKNHVGRAEQSIWAGGKHGDGFALCTEINFSAAGTANPVTLHGLDLLSPIEQLQIIDQTIRVRGNAHHPLGQILTENREIATLGTAVRGHFLVCQHGAQAWAPVHGGVRAINKAVVIHRFLLFDVSQRVVIRPVLSLQLAGLQQRNQLTDGTCLLLLCIEPRIENLQEDPLSPLVELRIRGGHRTTGIMAKTQRTELALHVLNVGHGGGAWVCTGLDRVLLCWQSEGVIAQGVQNVLAQHAVVAGENIRCDVTEWVAYVQASSGWVREHILDKELVLRKCFTVRRR

SEQ ID NO: 6840 - protein, 952 aa, Corynebacterium glutamicum
MTNPSEGTTPLAFRYTPELANKIEGEWQNYWTDNGTFNAPNPVGDLAPADGKALPEDKLFVQDMFPYPSGAGLHVGHPLGYIATDVFARYNRMLGKNVLHTLGYDAFGLPAEQYAIQTGTHPRTTTMANIENMKRQLGALGLGHDSRRAVATTDPEFYKWTQWIFLQIFNSWFDAEQQKARPISELIPLLESGELKTKDGADYNALGDVEKQKAVDDYRLVYRSNSTVNWCPGLGTVLANEEVTADGRSERGNFPVFRKNLSQWMMRITAYSDRLIDDLELLDWTEKVKSMQRNWIGRSRGAEVDFSAEGETVTVFTTRPDTLFGATYMVLAPEHELVDVLLEKAGSYEGVDARWTNGQASPAEAVAAYRASIAAKSDLERQENKEKTGVFLGVYATNPVNGDQITVFIADYVLTGYGTGAIMAVPAHDERDYEFATVLGLPIKEVVAGGNIEEAAFTESGEAVNSANDNGLDINGLAKDEAIAKTIEWLEEKELGRGTIQYKLRDWLFARQRYWGEPFPIVYDENGQAHALPDSMLPVELPEVEDYKPVSFDPEDADSEPSPPLAKAREWVEVELDLGDGKKKYTRDTNVMPQWAGSSWYQLRYVDPSNDEQFCNIENERYWTGPRPETHGPNDPGGVDLYVGGVEHAVLHLLYARFWHKVLFDLGHVSSKEPYRRLYNQGYIQAFAYTDSRGVYVPADDVEEKDGKFFYQGEEVNQEYGKMGKSLKNAVAPDDICNNFGADTLRVYEMAMGPLDTSRPWATKDVVGAQRFLQRLWRLVVDENTGEVLTRDEVLTDDDNKQLHRTIAGVRDDYTNLRVNTVVAKLIEYVNYLTKTYPDTIPAGAVLPLIVMVSPIAPHIAEELWKKLGHDDTVTYEPFPTFEEKWLTDDEIELPVQVNGKVRGRITVAADASQEQVIEAALADEKVQEQISGKNLIKQIVVPGRMVNLVVK

SEQ ID NO: 6841 - protein, 143 aa, Corynebacterium glutamicum
MWKPLLIAVGLLSLVCGAIGVVLPVIPTTPFLLLSAFCFTRSSERLHNYLVSHRIFGEYISNYYNHAMTPQHKFRTLLTLWCGIILSCFLIGATIPWIILPLIATGVSIHIIRLKPRPEATPTASSPEADSGSEPHFADDHKA

SEQ ID NO: 6842 - protein, 119 aa, Corynebacterium glutamicum
MQDAGERNNNDRPVMPGEILREEFMEPLGLSQNGLARAIGVPPRRINEIVHGKRAITADTALRLAAYLGPDPQFWLNLQTHYDLSVTYLDARTLLEAIKPYDRQQNVARTLNPLQESSQ

SEQ ID NO: 6843 - protein, 258 aa, Corynebacterium glutamicum
MLAELSVVHEGELTGVVGCAQPGQCQPLLQRKIVESCHLFKHRLVFNEAEARNLNLYGFAVTDVALWVTCVANAAWGTGDNDVASIQWVDVGDVFDELFWAKDQVIGRGGLYLLALEVGCQLAAELKRIWGSHPRPEASGLFQRLALVPLWSLCRCCVLEIAGGVIVHHCVASDVLSSIGLLDTACALANDNCHLAFPVESLVSPLWNDNIIERSDERVRELNKKGWGIREVAAHFFNVVGVVKADAHNLLRCWNYCI

SEQ ID NO: 6844 - protein, 241 aa, Corynebacterium glutamicum
MTTFHDLPLEERLTLARLGTSHYSRQLSLVDNAEFGEHSLLEGWTRSHLIAHVAYNAIALCNLMHWANTGEETPMYVSPEARNEEIAYGSTLNPDALRNLHEHSVARLDVAWRETSEDAWSHEVLTAQGRTVPASETLWMRSREVWIHAVDLGAVATFGDIPEVILRTLAAEITQKWTSQGAGEGLVLLDEPSSTRYPAAPGQDEVVVSGSLAGIVRYAAGRGSDGVTSSTGEVPEPPRWL

SEQ ID NO: 6845 - protein, 279 aa, Corynebacterium glutamicum
MRLATIRTNGTTIAARVESENTATTIEGFANVGELLQESNWRELAENAAGEAVTFENKELDAVVPAPKKIVCVGLNYANHIKEMGRDLPDTPTLFVKFPDALIGPFDDVVVPEWANKALDWEGEMAVIIGKRARRVKQADAAEYIAGYAVMNDYTTRDFQYAAPAKTPQWHQGKSLEKSAGFGPWMTTPDSFEFGGELATYLEGEKVQSTPTNDLVFSPEKLIEYITHIYPLDAGDVIVTGTPGGVGHARNPQRYIGDGETVKVEIAGLGFIENKTVFE

SEQ ID NO: 6846 - protein, 375 aa, Corynebacterium glutamicum
MGAPGKNDYATEHVKQEVPPATPEEQAELDTMYKRMDDLHLKPLWTQIGGLMPNHPEPRAVAHKWDWAELLKLAQRSGELVPVGRGGERRAIGLANPGLDGNTYISPTLWAAIQYLAPGENAPEHRHSQNAFRFVIEGEGVWTVVNGDPVPMRRGDFLLTPGWNYHGHHNIATEPMAWLDGLDIPFAYQMDTGFFEYGTEKLTDESTPDLSRSERLWAHPGLRPVSFPGKTSYSPIGRYAWEHTDAALNDQLALEEAGHPGTVAPGHAAIRFSNPTTGGDVMTTIRAEFHRLRPGASTAPIHEVGNRCFQVFEGSATINVGDKTFEANHGDVINVPSWQKWNIVAGSDGVDLFCFSDTPIFEALNLARTFTPEGI

SEQ ID NO: 6847 - protein, 260 aa, Corynebacterium glutamicum
MIMDNVAPTQGLPPKEFLSSVDIALQLILLLRDSGSLTISGAAETLGVGASTIHRSMSMLVYRGFAVRSESRTYLPGSALATSALQPGLGADLTKKCSHYMESIGKETGETTHLVILQGDSVHFIHSVEGSLPVRVGNRRGQVMPAIQNSGGLVMLAEMSARELRALYSSLGDEEFENLRKRLRRTRDRGHGANFGFFEQDVSAVAEPLLNDVGDVLGAITVAVPSNRFREVYPKAVQVLERHMRDLNKALADYRVPEKG

SEQ ID NO: 6848 - protein, 452 aa, Corynebacterium glutamicum
MAHLDYVFMTSHAPESGGLVTESTLGASNSSQTIENKGLTILGISGRRLAAVLIGWFFVIFDGYDLIVYGTVQSALAKEWNLSSATLGTIGSTAFFGMAIGAVFIGRLSDRVGRKAAVIGSVLILSVFTMLCAFAPNPWVFGAFRFIAGLGLGGLVPSVNAMTSDLVPRKTMSAWATVMMSGVPIGGSIAAVLALVVVPSSEEWGWRFMFLIALIPLVVGLPIAMKVIPSDKAIKADHDIREGHDEPAGFKDLLVDRYRWISIWFALATFVTLLAWYGLGTWLPRLMETAGYEFGHALMFTLALNLGAVIGSVVTAWAGDRFGPIRSGVIAAGIAGIALLLLLTYPPVTAVYVILILAGVGTHGTQILIIAAVANFYPSNLRGTALGWALGVGRIGAVVAPQLAGLLLAWNLGVNSNFIMFGTAALLSALALSVLLRLQKTYSVTHKVEIQG

SEQ ID NO: 6849 - protein, 442 aa, Corynebacterium glutamicum
MSLPHSDELRGQKIIISGGGIGGAAGALALALRGADVTLYERAAEFKEVGAGLQIGPHGWRMLESWGLLDQIVVAGYLPEDMQFRDAVNRETILTMRFDEEFQQHYGGRYLVIHRSDLLNILVTNAEAAGAKLHNGVLVTDSRTVDGGIEVDIESSINKGEDNKTLLVDAFLAFDGIHSVMRKKLVDDAPVASSYVAYRGTSKLAEDAEMKDLKSVIGYIGPHVHFIQYPLRGGELLNQVAVFESQRYLDGRTAGDIPEDWGNPEELDRAYNHCDPFIQDRLDTLWRNNWWQMSDREPLENWRIGRMLLLGDAAHAPLQYLASGAVMAMEDAEAVALFAADAARAGNLDWEEVLAEVEAERRPRCSRIQTVGRFWGELWHVEGTARLIRNEVFRQADRNGWFIYADWLWGYDASKRAHIANPELGEMPQALKEWRYALLEQK

SEQ ID NO: 6850 - protein, 417 aa, Corynebacterium glutamicum
MDIKSMSSSLLFRVIVAIILGIICSLFFPVWLAEIFTTFNGLFSNFLGFFIPVLIFSLIAPAIAGLGRGAGKWLGIVAAIAYASTVFSGLIAYGASQALYPWLLKDHQSVTEIDLDAGALQPYFNIEMPPPFEVMTALLLAFCLGLGMAVIKSDTLFKVTRELERVVMKTITAFVIPLLPLFIFGIFLGMGMNGGLLEIMSAFGKVLILAVVGTLLFLAIQFIIAGAVSKKNPWKLFKNMLPAYFTALGTSSSAATIPVTYQQTLKNDVDVNVAGFVVPLCATIHLAGSMMKIGLFTFAVVFMYDMEVGVGLSIGFLLMLGITMIAAPGVPGGAIMAATGMLASMLGFNTEQVALMIAAYIAIDSFGTAANVTGDGAIAVIVNKFAKGQLHTTSPDEIEEDDRVAFDITPSDVEHHK

SEQ ID NO: 6851 - protein, 170 aa, Corynebacterium glutamicum
MTVIGIILGSLFGVLAVLLIVVGALGWAAKLPGNPVVGIRVPEVRKSQELWDMAHRVAGPLWVLSGVSFVIASLVAFVASGWMWLVVALGVVAAIVFIGMGAGMAAHTVAMVDAKRSRETPQAPVSAEIEEAGGVTITSPIINKTPLNAPKIDLDAVRRAAETTQEPKND

SEQ ID NO: 6852 - protein, 518 aa, Corynebacterium glutamicum
MSTNPHVFSLDVRYHEDASALFAHLGGTTADDAALLESADITTKNGISSLAVLKSSVRITCTGNTVVTQPLTDSGRAVVARLTQQLGQYNTAENTFSFPASDAVDERERLTAPSTIEVLRKLQFESGYSDASLPLLMGGFAFDFLETFETLPAVEESVNTYPDYQFVLAEIVLDINHQDQTAKLAGVSNAPGELEAELNKLSLLIDAALPATEHAYQTTPHDGDTLRVVADIPDAQFRTQINELKENIYNGDIYQVVPARTFTAPCPDAFAAYLQLRATNPSPYMFYIRGLNEGRSYELFGASPESNLKFTAANRELQLYPIAGTRPRGLNPDGSINDELDIRNELDMRTDAKEIAEHTMLVDLARNDLARVSVPASRRVADLLQVDRYSRVMHLVSRVTATLDPELDALDAYRACMNMGTLTGAPKLRAMELLRGVEKRRRGSYGGAVGYLRGNGDMDNCIVIRSAFVQDGVAAVQAGAGVVRDSNPQSEADETLHKAYAVLNAIALAAGSTLEVIR

SEQ ID NO: 6853 - protein, 57 aa, Corynebacterium glutamicum
MGIRAHGAPTEEIIVGLKPFWETSNNYSLRASFDPGLAGCGLKTTKGPLLRRTKYEP

SEQ ID NO: 6854 - protein, 208 aa, Corynebacterium glutamicum
MTHVVLIDNHDSFVYNLVDAFAVAGYKCTVFRNTVPVETILAANPDLICLSPGPGYPADAGNMMALIERTLGQIPLLGICLGYQALIEYHGGKVEPCGPVHGTTDNMILTDAGVQSPVFAGLATDVEPDHPEIPGRKVPIGRYHSLGCVVAPDGIESLGTCSSEIGDVIMAARTTDGKAIGLQFHPESVLSPTGPVILSRCVEQLLAN

SEQ ID NO: 6855 - protein, 348 aa, Corynebacterium glutamicum
MTSPATLKVLNAYLDNPTPTLEEAIEVFTPLTVGEYDDVHIAALLATIRTRGEQFADIAGAAKAFLAAARPFPITGAGLLDSAGTGGDGANTINITTGASLIAASGGVKLVKHGNRSVSSKSGSADVLEALNIPLGLDVDRAVKWFEASNFTFLFAPAYNPAIAHVQPVRQALKFPTIFNTLGPLLSPARPERQIMGVANANHGQLIAEVFRELGRTRALVVHGAGTDEIAVHGTTLVWELKEDGTIEHYTIEPEDLGLGRYTLEDLVGGLGTENAEAMRATFAGTGPDAHRDALAASAGAMFYLNGDVDSLKDGAQKALSLLADGTTQAWLAKHEEIDYSEKESSND

SEQ ID NO: 6856 - protein, 474 aa, Corynebacterium glutamicum
MTSNNLPTVLESIVEGRRGHLEEIRARIAHVDVDALPKSTRSLFDSLNQGRGGARFIMECKSASPSLGMIREHYQPGEIARVYSRYASGISVLCEPDRFGGDYDHLATVAATSHLPVLCKDFIIDPVQVHAARYFGADAILLMLSVLDDEEYAALAAEAARFDLDILTEVIDEEEVARAIKLGAKIFGVNHRNLHDLSIDLDRSRRLSKLIPADAVLVSESGVRDTETVRQLGGHSNAFLVGSQLTSQENVDLAARELVYGPNKVCGLTSPSAAQTARAAGAVYGGLIFEEASPRNVSRETLQKIIAAEPNLRYVAVSRRTSGYKDLLVDGIFAVQIHAPLQDSVEAEKALIAAVREEVGPQVQVWRAISMSSPLGAEVAAAVEGDVDKLILDAHEGGSGEVFDWATVPAAVKAKSLLAGGISPDNAAQALAVGCAGLDINSGVEYPAGAGTWAGAKDAGALLKIFATISTFHY

SEQ ID NO: 6857 - protein, 232 aa, Corynebacterium glutamicum
MVDAKDLRTQLDGAGDFLLINNLGEDIQIKTRSLGSECCVLFIIKHREHEQDGISTKVTRRVYLDRINDEVFAQHRKMRGSGNGSEVIVIATKTIRLAQHGNAAGVARVHASDFTRLVVLTNHSQRRRCGLALHDETRPSPTLVEGIKQRTGGFWKRIHIHVSDASANFLQVSATTLDDAFQHCGQIITSHWKTPFLSNRSLRAWPTMPGWCRRQARKAPFVHHLSRSRHRR

SEQ ID NO: 6858 - protein, 417 aa, Corynebacterium glutamicum
MTEKENLGGSTLLPAYFGEFGGQFVAESLLPALDQLEKAFVDATNSPEFREELGGYLRDYLGRPTPLTECSNLPLAGEGKGFARIFLKREDLVHGGAHKTNQVIGQVLLAKRMGKTRIIAETGAGQHGTATALACALMGLECVVYMGAKDVARQQPNVYRMQLHGAKVIPVESGSGTLKDAVNEALRDWTATFHESHYLLGTAAGPHPFPTIVREFHKVISEEAKAQMLERTGKLPDVVVACVGGGSNAIGMFADFIDDEGVELVGAEPAGEGLDSGKHGATITNGQIGILHGTRSYLMRNSDGQVEESYSISAGLDYPGVGPQHAHLHATGRATYVGITDAEALQAFQYLARYEGIIPALESSHAFAYALKRAKTAEEEGQNLTILVSLSGRGDKDVDHVRRTLEENPELILKDNR

SEQ ID NO: 6859 - protein, 280 aa, Corynebacterium glutamicum
MSRYDDLFARLDTAGEGAFVPFIMLSDPSPEEAFQIISTAIEAGADALELGVPFSDPVADGPTVAESHLRALDGGATVDSALEQIKRVRAAYPEVPIGMLIYGNVPFTRGLDRFYQEFAEAGADSILLPDVPVREGAPFSAAAAAAGIDPIYIAPANASEKTLEGVSAASKGYIYAISRDGVTGTERESSTDGLSAVVDNIKKFDGAPILLGFGISSPQHVADAIAAGASGAITGSAITKIIASHCEGEHPNPSTIRDMDGLKKDLTEFISAMKAATKKV

SEQ ID NO: 6860 - protein, 513 aa, Corynebacterium glutamicum
MDWLTIPLFLVNEILAVPAFLIGIITAVGLGAMGRSVGQVIGGAIKATLGFLLIGAGATLVTASLEPLGAMIMGATGMRGVVPTNEAIAGIAQAEYGAQVAWLMILGFAISLVLARFTNLRYVFLTGHHVLFMSTMLTIILATAGFDAWIVVGVGALLLGILMVSLPAFAHPWTRRITGDDSIAIGHFGTAGYVAAGAVGRLVGGKGKKASPSTEDMKVPEGLRFLRDSMVSTALSMAIMYIILAILFLVRAGEEEAFTAFPNGATNVGNYIMQSFTQGLQFGVAVAVILFGVRTILGELVPAFQGIAAKVVPGAIPALDAPIVFPYAQNAVLIGFLSSFVGGLVGLTVLASWLNPAFGVALILPGLVPHFFTGGAAGVYGNATGGRRGAVFGAFANGLLITFLPAFLLGVLGSFGSENTTFGDADFGWFGIVVGSAAKVEGAGGLILLLIIAAVLLGGAMVFQKRVVNGHWDPAPNRERVEKAEADATPTAGARTYPKIAPPAGAPTPPARS

SEQ ID NO: 6861 - protein, 270 aa, Corynebacterium glutamicum
MFVLKDLLKAERIELDRTVTDWREGIRAAGVLLEKTNSIDSAYTDAMIASVEEKGPYIVVAPGFAFAHARPSRAVRETAMSWVRLASPVSFGHSKNDPVNLIVALAAKDATAHTQAMAALAKALGKYRKDLDEAQSPEEIQAILEKAAAPAKQKAPAVAPAVTPTDAPAASVQSKTHDKILTVCGNGLGTSLFLKNTLEQVFDTWGWGPYMTVEATDTISAKGKAKEADLIMTSGEIARTLGDVGIPVHVINDFTSTDEIDAALRERYDI

SEQ ID NO: 6862 - protein, 302 aa, Corynebacterium glutamicum
MNTPAVQVQNLSLSFGSFTAVNGLSLTVEQGSIHGFLGPNGAGKSTTIRALIGVLKPQTGSVAILGQDPVAHPDVLRRVGYVPGDATLWDNLTGAEVFRALESLRKTPSNRALENELIDAFQLDPSKKIREYSTGNRRKVSLIAALSHEPELLIVDEPTAGLDPIMEQVFVTYVRKARTNGASVLLSSHILSEVEQLCDYVTVLKEGRAVASNEVSYLRKISAHRITATIPAVPQHLAGRGEVDFDAGHLSITCDASEVPDILRIIIDAGGQDIISTAASLEEIFLRHYGETVSGSESKASQ

SEQ ID NO: 6863 - protein, 528 aa, Corynebacterium glutamicum
MIRLNLRLRRMLILWWLLGIWVFLIITPPSYVATYPDLASRGPVVSSVQNNVGTQAMYGYLPSPGTIGQLTAWETGAWLCVLSSVMMVLLFSSLHRKPESSGLVEYVYAAGRSGSSRFGAAIATGTIVSVLNGAVCAFILLAFRYLSIDEITVAGSIAFGVTITLTMLATMAITSILQSLWGRGTNFNRLGLLSVGAAFLIRMFADTSSSSWATHLNWVSPQGWRTVIAPFTEDSWLKALVLAIVCAALIGVAFTLDSRRPFDESLLHLRGSKRYRERKIRSLYSLNMVLHRGNLITWSIVIGLVLLIFLPLIDSLLPSLQGDAATMQAVEAFLPAGELQITFIVYVFQIASILLSIAVVLPVIGFIGQEREGLIDAVRSTGVRRWSPLWGCVQACLSTLTSCTIFAILCALLGLYLQPSTVEDGTSLMVLSGLSIAVHALFFLGIAIAVAGLAPRVIHLAWLPIIAASVVTLLGPLFSLTEQQMEFSPLTHSWANSDEAVWPLLTFAIIGVALGGVGLLGAQRRNLL

SEQ ID NO: 6864 - protein, 150 aa, Corynebacterium glutamicum
MGRSEGTYFSNWLNKILWTILGIMTQPAPMCSRRMFLLGTATTFAGAFLAACGTEPDQEVAATEVPVGSSVILGSVIIAQPTEGNFVAYSSACPHQGSRITKVEGDTVICTNHKSVFNISDGSVVSGPAQNGLTSANLKQDGDTLSASVQ

SEQ ID NO: 6865 - protein, 370 aa, Corynebacterium glutamicum
MDFWTILDTMTSLLTPIAIRGLEIPNRMWLAPMCQYQANNLDGVPLDWHLVHYGARAVGGFGLLIAESTGISPEGRISSRCTGLWNEAQVEAWERITNFVHAQGGLIGVQLNHAGRKASTYPALPNFPTGTQSVDEGGWETFGPSAVAQPGLADPTELTREGIEKVIQDFAAAAERAVRAGFDAVEVHGAHGYLLHQFLTPVANKRTDIYGGSFENRTRLFREVAQAIRAVIPGSMPLIARISATDWIDDEPSWDDDQTVSLVSDLKKLGVDAVDISTGGAVPATIPVEPSYQVKFARRVKQEVGIPTSAVGLITHVGQAQGHLDRGDADIISLGRAALRYPSWPLFAAHELGKTRDEIPYPPSYVRGAW

SEQ ID NO: 6866 - protein, 324 aa, Corynebacterium glutamicum
MLERLKRLDPLIVLIVLAVIVAIIIPVRGVAADWFDVAVKIAIALLFFLYGARLSTQEALNGLKHWRLHLTILAITFGIFPLIGIGLEPMTAFVSEDIYRGILFLTLVPSTVQSSVAFTSIAKGNVAGAIVSASLSNLAGVFLTPLLVMLIMSAGGGVHVDSQVFLDIAIQLLLPFILGQVCRRWVKNFAANKATKIVDRGSIAMVVYSAFSAGMVAGIWSTVSVLEIIYLIVFAILLVMAMLWFTLFMATRLGFNRADSIAIQFCGTKKSLATGLPMAAVIFGGANIGLLILPLMIFHQVQLMICAWLAARYGRDAQEQKANA

SEQ ID NO: 6867 - protein, 258 aa, Corynebacterium glutamicum
MTHTLQATNPLDQTAWHAWHFSRNKEAISRTGATSLSATEWISATTLKDAHTFPSLPGRWYKRGGGVVGAHLPPAFATTGTVQLRPGELLIAEDFTLTVIERLGQFALQVFDARNPKRFEFHSIAAFPPSEEWRIEARFFPEPDTVNTAAADGVIVATPTAGWVHFLKGRLDYRLRVTVQKNNLRALFSDNSSTLGVYQHRFVDIPRPDAEGNTIIDFNRAYLPPKALNRKFLCPSPSLNNHLNLTVEAGEKWVVAGG

SEQ ID NO: 6868 - protein, 116 aa, Corynebacterium glutamicum
MEGVMARKLEHPSLAEMNLNAIMFALSDPIRRQILSQLSCGHNDQACVAFELPVSKSTSTHHFRVLREAGLITQRYEGTAILSALRSEDMEARFPGLLTSVMRAEVEERNAADLPV

SEQ ID NO: 6869 - protein, 364 aa, Corynebacterium glutamicum
MEPLVSKLFTPIQIRDITIPNRVWMSPMCTYSAATGSGLPTDFHQAHYAARAAGGVGLVMVEATGVNPVAPISPVDLGLWSHDQIEPFSRVTAAIRAGGAVPAVQLAHAGRKASTDAPWNGGGYVGPETNGWETVGPSPLAFPGLPAPRELTVSEIQEVVQQFAGAAVRADQAGFDVVEIHAAHGYLLHNFLSPISNKRTDSYGGSLENRARIVLEVIDAIRAVWPEEKPVFMRISTTDWVEENPQDDRESWTLSQSRQLALWASEHGVDLIDASSGGLDIVPIPHDRDYQTAKAADLHASTGVTVAAVGRIDDAQTAHNLVDSGDVNAVFLGRPLLKDPSWANQAALALGAEPRYVHQYDYVL

SEQ ID NO: 6870 - protein, 216 aa, Corynebacterium glutamicum
MKVFIIGAAGGIGNRLSSLLHARGDAVSGMHRNLEQASKITDTGATAVLGDLIHNSTEELAELFRGHDAIVFSAGAHGTGQENTTLIDGAGLRKAADAASAANVSRFILVSAFPESSRGENTTENFEHYMKVKKSADVYLSHTDLDWVIVRPGVLQDEAGDGLVTAGLAINYGNVARDNVAAFIDEALHQPQLSKIIVELTDGSTPVAEAVERLIK

SEQ ID NO: 6871 - protein, 51 aa, Corynebacterium glutamicum
MFDQIQHFTDIAQNFKPAQWGAQIQEQFQHFQGWARPEAVESQHYTSSLSS

SEQ ID NO: 6872 - protein, 64 aa, Corynebacterium glutamicum
MLLYNNHFKEITMFDQFQQFTDIAQNFQGAQWGVQIQEQFQQHFQNWFNTETVEPAKSTFSLSS

SEQ ID NO: 6873 - protein, 56 aa, Corynebacterium glutamicum
MFDQIQHFTDIAQNFQPAQWGAQIQEQFQQHFPQQIQQWVRPEAAPLPERTSSLSS

SEQ ID NO: 6874 - protein, 107 aa, Corynebacterium glutamicum
MLVSHDDMPFPQLDHDDGGIPINFSIFAFVQVTELKIGLTAVCGKNFFGVNFKSQQRNTPSLAHLASTRESEFFSWDTSSTSSTLSWEAFPTSSLQSFFLPKSHSTT

SEQ ID NO: 6875 - protein, 251 aa, Corynebacterium glutamicum
MKSIFISGAANGIGKAVALKFLHEGWLVGAYDLAEITYSHPNLRWGYLNVRQSESWDKALEDFATHTGGTIDVVDNNAGVIIEGPLQDAEEGSVDKLLAINVNGVTLGARAAHPYLARTPGAQLLNMSSASAVYGQPQIAVYSASKFYVAGLTEALNLEWRKDDIRVVDVWPLWAKTDLVNGVKAKSLKRLGVRITPEQVAQAVWDAVHPKSRWAKGKVHHGVSKLDKALYLMKSLSPDRVAMCFARLIAG

SEQ ID NO: 6876 - protein, 60 aa, Corynebacterium glutamicum
MTPAGPAQLLIVALVVIVLFGSNKLPDVARSVGRSMRIFKSEIKEMNKDQIESSDQTLKN

SEQ ID NO: 6877 - protein, 453 aa, Corynebacterium glutamicum
MQSILAFYLYYSVTDGGLGMNQTAALSIVGAYGGFVYMTSLVASFIADRVLGSERTLFYSAIIVMLGHIALALIPGYTGLSIGLVLIGLGSGGVKTAAQVVLGQLYSRTDTRRDAGFSIFYMGVNLGGLFGPLITNALWGWGGFHWGFGIAAVGMALGLIQYVAMRKTTIGAAGHTVPNPLPKNEYARWIIGAVVVVAAVVALIATGIIKLEWLSNITAAIALIAAIALLAQMYVSPLTTAAEKSRLLGFIPMFIGGVLFFAIFQTQFTVLAVYSDTRLDRNFFGIDLPPGLINSFNPIFIIIFSGIFATLWTKLGAKQWSTAVKFGVANIVIGCALFFFLPFAGGAENSTPMALIIWVYFLFTIAELLLSPVGNSLATKVAPEAFQSRMFAVWLMAVSMGTSLSGTLGGYYDPTDAGSEKVFFITVGVAAIVLGAIVIAAKGWVLKKFIDVR

SEQ ID NO: 6878 - protein, 57 aa, Corynebacterium glutamicum
MKSTFGHHVLNKEQNGGKEVCAKDIKRSTISSATTQTGCTPSVDFHTNGPQFEIIHK

SEQ ID NO: 6879 - protein, 185 aa, Corynebacterium glutamicum
MNLKDLKAAETRQRFIDVAHELFLEHGYGSTSMNQIAQAAGGSRANLYLHFRNKPDLMMAKMRELEPAVRTPVLKVFDLPEHTLESILRWLDSMTEVWKANAKVFGAMEQAMVEDAAVADEWLSMMQRLSQSVPELVENEERRVQFLASLMGMDRNFYFLYVRGQDVDEELLKLAVARQWLAVFQ

SEQ ID NO: 6880 - protein, 301 aa, Corynebacterium glutamicum
MTTTTADHNISAQQKAVEENLVNRVLQSFDACENPRLKQLMESLVVHLHDFIRDVRLTEDEWNYAIDFLTAVGHITDDKRQEFVLLSDTLGASMQTIAVNNEAYENSTEATVFGPFFLDDAPEVELGGDIAGGAQGQAAWIEGTVTDTEGNPVPNARIEVWECDEDGLYDVQYADERMAGRAYMHTDANGDYRFWGLTPVPYPIPHDGPVGNMLKAVGRSPVRCAHLHFMVTAPELRTLVTHIFVEGDPQLEIGDSVFGVKDSLIKKFEEQAPGTPTPDGRDLGDQTWARTRFDIVLAPGA

SEQ ID NO: 6881 - protein, 363 aa, Corynebacterium glutamicum
MNNSLAFNHDTLPQKVMFGYGKSSAFLKQEVERRGSAKVMVIAGEREMSIAHKVASEIEVAIWHDEVVMHVPIEVAERARAVATDNEIDLLVCVGGGSTIGLAKAIAMTTALPIVAIPTTYAGSEATNVWGLTEAARKTTGVDLKVLPETVIYDSELTMSLPVEMSVASGLNGLAHCIDSLWGPNADPINAVLAAEGIRALNQGLPKIVANPHSIEGRDEALYGAYLAAVSFASAGSGLHHKICHTLGGTFNLPHAQTHATVLPYVLAFNAGDAPEAERRAAAAFGTDTALEGLQRLRLSVNAPKRLSDYGFEASGIAEAVDVTLEKVPANNPRPVTRENLSRLLEAALNGEDPAVLSAVLSN

SEQ ID NO: 6882 - protein, 508 aa, Corynebacterium glutamicum
MTDIKATSSTSATTAPTAGRPARRLGQISLVACLGGLLFGYDTGVANGAEGHMAQELGLNVLQLGVVISSLVFAAAFGALFAGRISDEIGRRKAIITLSVLFFLGSILVVFSPAGELGQFYGPGFATLVTGRIMLGLAVGGASTVVPVYLAELAPLEIRGSLTGRNELAIVTGQLLAFVINALIAVTLHGVIDGIWRIMFAVCALPAVALFLGMLRMPESPRWLVNQGRYDDARRVMETVRTPERAKAEMDEIIAVHSENNAALPGVKQSSGQASGQVSSKHTHMSIGEVLSNKWLVRLLIAGIGVAVAQQLTGINAIMYYGTRVLEESGMSAEMAVVANIAFGAVAVIGGLIALRNMDRLDRRTTFIIGLSLTTTFHLLIAAAGTLLPEGNSIRPFAIMILVVGFVLSMQTFLNVAVWVWLAEIFPVRMKGIGTGISVFCGWGINGVLALFFPALVSGVGITFSFLIFAVVGVIALAFVTKFVPETRGRSLEELDHAAFTGQIFKKA

SEQ ID NO: 6883 - protein, 287 aa, Corynebacterium glutamicum
MPPAKTQEFDPSRIKEPNSPSVITKAATLMDVLRTEGPTNSARLAEVLGEPISSVYRMLHTLTAIGWVEQDGKRGSYRVGLAMLTLAELQLRHMDLRKIAALTMRKIHALTGETTFLCVRHGIRAVCIERVDGDRVNSRVLQLGTSLPLHVGAAPRALLAFEGRRAWETYATNLGFEGHNWSKGPSRGELFQHLDEDRDKGFCLVDNEITPGIAAVGAPIYNHRGEVVASLSMSGLRDGILSDTTDYSAVELILQGSAEISQALGATIEHNGGNQKLPQVTPLSIVV

SEQ ID NO: 6884 - protein, 359 aa, Corynebacterium glutamicum
MSDQKIVVGLLGITHPHASARVRALREIDGVEVVAAADTDSRLQYFTDKYDVEPREIDDVLNDDRINAIMVHSKSKDMVPHAKRALAAGKSVVVEKPGGGTVADLEELLALKEAADPQRIVQVGYNVRLSESVQRLKELLDAGLIGEVVSVQARGAAKVGEHITEHLNQPADMGGVLWILGCHMLDALVEVFGAPESVNARVHKTAKLSDDTSREDSASALLYYPDFSVSFSFDGHDDLEWFESSRLTVYGTKGMIEAGILPQTLRVYLNESRQGWPQGWTEWTQSYFTPPFARTESNKFSELPELENISNFRTEMQGWVNSIRTGSRNVAPVEDALTVARIVSACYESDNNQGISVNI

SEQ ID NO: 6885 - protein, 293 aa, Corynebacterium glutamicum
MKPQLIASCWTSAGDAAPDRDDLSSPVAIDERIALVAETGWAGIGLVHADLIKARDTIGYEELRRRIHAAGIEIIEVEFLNGWWATGAERQESDAVRADLFAAAQALGSPHIKVGAGEGTNGVVPIAHMASAFTDLAAEAEAHGVKLALEATPFSHLKTIYDALEVVSHSDSPSAGLMVDIWHTAKIGIPNDELWRNIPLSKVNAVEVDDGFIDTPIDLFDDSTNRRAYCGEGEFDPASFIRGAIDAGWTGAYGVEIISAEHRSLPVKEGLQRAFDTTIAAFEQAARLAPSTN

SEQ ID NO: 6886 - protein, 335 aa, Corynebacterium glutamicum
MTLRIALFGAGRIGHVHAANIAANPDLELVVIADPFIEGAQRLAEANGAEAVASPDEVFARDDIDGIVIGSPTSTHVDLITRAVERGIPALCEKPIDLDIEMVRACKEKIGDGASKVMLGFNRRFDPSFAAINARVANQEIGNLEQLVIISRDPAPAPKDYIAGSGGIFRDMTIHDLDMARFFVPNIVEVTATGANVFSQEIAEFNDYDQVIVTLRGSKGELINIVNSRHCSYGYDQRLEAFGSKGMLAADNIRPTTVRKHNAESTEQADPIFNFFLERYDAAYKAELATFAQGIRDGQGFSPNFEDGVIALELANACLESAQTGRTVTLNPANV

SEQ ID NO: 6887 - protein, 361 aa, Corynebacterium glutamicum
MKNITIGMVGVGRIGRMHVANMLAVAETLKERDLNIEIVLADAMPGFAEQVGADMGVKAAASVDKLIEDGVDALFIATSTAGHVDVLRKGIAAKLPMFCEKPIASDVPESLNIIREIDAAGATVQVGHQRRFDLGYQEAKRRLDAGDLGWLHSLKAVSSDAFPPPVSYCATSGGLFRDVSLHDFDIIRWLTGQDIVEVYAKGSNNGDPEIGAVGDIDTGAALLTLADGTLATAIATRYNGAGHDVRLDVMGSKDSTIVGLDEKSAFASAEEGIDFPTGESHPTFAERFADAYKNECIAFVELILGERENPCTPADAVAAAIVADAAQLSLVTGEPVKIPTVREILEGSAQPVEVRALVPSA

SEQ ID NO: 6888 - protein, 1344 aa, Corynebacterium glutamicum
MVWIEYSSSTVDTAAFSEQDFRDFYGMDSSARIFRATGQAGLANGGDRGIRVLYNGEVSGWSHYPSDSAAVQKGIDFALPKVGEQASIAVRTKTDPTPGSITSDQLIPGGLDTPEEPEAPEDSLFEGRTPPRDAAPLILTELMVNSTNMGSSDGFEYVEITNTTAEPIDFSDYTLNYLYPQDEFTNTNEAVWAAEPGDVIIQPGKSLVFWIKNGPNDEATAADFNAEYGTNLEAGKDLVEISSGGMANGTARGMQIQTNTGHIVNRGFYNMAGASDVKANEGLHFAVDESDLLKQTLVGSGAPTPGTVYTSQIPNPLSAVIADSSVPLITDNTATSINPAEPFTFAFNITDDVQVRTATLHVTSSAGEAATTINLTEDDGSFNWALPAADLTGKSWFEYTVTATDGFNSVTTEPVRVTVDGANTDPLRLNLEENQWVSGTTDVIGASDVFGDKLELLIDDAPAVTNSSLSAAPTFAMEVTQTDVFFRNGILAGGEELRIFDQGTYANTETISTPVPLYHINEDGTLTVSVYAGTKAAPEIDLNENNDDFQIRNLRLILPDGRTLTPAGISDSNAWLNMGDSAGKLDFFDATFALPEDAFTGVAHAWDTTQSTDGEHHITISREDGGEISRTIRVDNTAPELTVSGVEEGQELRGTVEIDAQATDAGAGVKSVETLLDGERVQLPLTTGSIALDKGEHTLVIRAEDEVGNRTEKTITFSTPDENPISGDYAPSNGATVGVGDVKLSARASDPSGDTVKMTFLEADSPKLDSGRVRMSSGTVEDAGSVSRAEAKMLERGDVEKLSSLDGLGMEVTSDAALPYQLFEVDAADALAADTEVRLNWAGSADGRAQVIMYVFDGEAWVEVDRHLTGDELEEFTLQGVVNAEKFAIGGTVTVLIQHSEGFAGADHSTRNSDVTAAHPDDVARSEYDFTLAWESDTQYYNEEFHEHQTNIHDYVLAERENKNIQFMFHTGDVVDDWDQPAQWATANPEYQRLDDAGLPYSVLAGNHDVGHTSNDYTEFSRHFGEQRYVDNPWYGESYQDNRGHYDLFSAGGIDFINVAMGWGPDDEEIAWMNEVLAKHPERVAILNLHEFMLTTGGLGPIPQRILDEVAATNPNVSMIMSGHYHDAFQRTDSFDDDGDGVDDRTVTSMLFDYQGLPEGGQGYLRLLHFDNQGQKMMVRTYSPSLKDYNSDEPSLLGPAEDPNMYQEFEVSYEQLGIKPEGRTLIGDSFSADFLTSNEIGIVDEVPSGTIASTNWKDVTEGRHSWYVRSEDPFGGVEISPVQSFIAGEEAGGNAPGTGSSNGGSSHGLWGALAGFFAGAAALAGAAIAFVPGIWDYVTNAFKR

SEQ ID NO: 6889 - protein, 215 aa, Corynebacterium glutamicum
MRSSSPPARMPLRKNTSVWVTSIANVGAADRLELVTAGASSISNSSLSPKTSEAPITSVVPLTHWFSSRLRRSGSVLAPSTVTRTGSVVTLLNPSVAVTVYSNQDFPVRSAAGRAQLKEPSSSVRLMVVAASPALEVTCSVAVRTWTSSVILKAKVNGSAGLILVAVLSVMSGTEESAITADSGLGICEVYTVPGVGAPLPTSVCFRRSDSSTAK

SEQ ID NO: 6890 - protein, 206 aa, Corynebacterium glutamicum
MGFSSGVLNVMVFSVRFPTSSSARITKVCSPLSKAMEPVVSGSCTRSPSRSVSTLFTPAPASVAWASISTVPRSSCPSSTPETVSSGAVLSTRMVRLISPPSSREMVMWCSPSVLWVVSHACATPVKASSGRAKVASKKSSFPALSPMLSHALESEIPAGVRVRPSGRISRRFLIWKSSLFSLRSISGAALVPAYTLTVRVPSSLM

SEQ ID NO: 6891 - protein, 362 aa, Corynebacterium glutamicum
MSPARTQPRAAFLRKLRPITCSLSLVLVGCSNTAESTTTDTAGSTETSSQISPTTPVSTTEAAPPEDPSANALEEYAQILANPSIYPLTEISQFVPTGTYAYTLVEATSDSIPELLLRADSHEFAPILVFTYDENTQSATQAGGVLIDGVASAGGSRVKVRASNSGAGIYQLNWYSIQPVGESSLYGIQGNSLTQIADPEDFMVRELLPDHHEITWVDSNDPSGLSTVQTGGANIQQAAPTPVQQPASNLHYFSGVVTMQTAGELMRGERTPNGEPATDLYLVLVLDSPIEITARNAATDPQTRTISEVSLGRYIPADGDNDWIGYLDTHVEITATTDQVWFPTDTGLPLGMLRLADYKSIS

SEQ ID NO: 6892 - protein, 248 aa, Corynebacterium glutamicum
MGIFRSRSQDFGWSMHQAGQLINDPSQGLWRTSALRSPVARVGHAVLRQRAGEISRMQGREFSRPGDQFRQVDLRRRLIQVHPQSIPTADAMAVTITMALTAATIDPVKFVADSQNPDEEIYLAAQIALREMVIAMPLEDFIGVRIDLEPVLVAAQAAAKNVGVEVSSILLKDLNLPQEYSGALQESIVAKIQAETDLERARNEVKTTRARLASAKVLEQNPILAKIRMIEALPPGSTIEVREGDSKA

SEQ ID NO: 6893 - protein, 323 aa, Corynebacterium glutamicum
MEKQFFTGKRFDVRDLESIAFVLRDEPHFRGLYRLSFATGEAYVGQSVNVVNRFTGHRRRWDDIISLEFFPFANEDLNPLEKTLISMTEESTSVRNIRDAGKPRGEEDFVFDSENGVSSPLSWDREKRIPPGSYVVSTESAKFVQLAQQPNYRPLRDVVGWYLYQTYPDPFNTQRHLWVCSAMPTTNKSKNHQRLLALSAGMLETFVAFDDRDKQAPNVEIFINTARSSISADELSHPDGFWQVEHHNRYKASEVTAWYFTLEGLEAIIFGDLEFPHLDLMLDLAYELNVKLMRHGGTIFRRFHNNLLAADLLAASLQWRART

SEQ ID NO: 6894 - protein, 1643 aa, Corynebacterium glutamicum
MSTITDAVSALRTLPSQSAQGLAFEKLMVNFIKSDPTLSTEFDEVHRWVDWPYNGGTMDTGIDLVAYNKDDDAYTAIQCKFYLPTTSLAKGQLDSFFEASGRTFETPEGTRSFSNRLVISTTDKWSSNAEKMLENQTIPTNRIGLSAIAESPIDWDIAYPGSELTINLQLKEPYSPRPHQQTAIEKAIEGFQTHDRGKLIMACGTGKTFTALRLSEEVARLNGNKARILFLVPSISLLSQTLKEWTAQKTMDLRPVAVCSDSKVSKAAEDIAAYDLEVPVSTDGALIAEKLEHRKRAAGLTVVFSTYQSLPAVHAAQEAGAEPFDLVICDEAHRTTGITLAGEDPSNFTRIHDASYIKAAKRLYMTATPRLFDDSVKGKAADHSAEVSSMDDEAIYGPEFHRLGFGEAVEKGLLTDYKVVVMTVDEQVAASALTVLGSTPGEELTLDMTSAIIGAWNGLAKRSGKEQDTKTGFSSSDAAMERAVAFARDIKTSQQIAESFPRVVNAYTTELEVKNDDVDEHNLNLSVACQHVDGSMNALERNSRLTWLKAPTQSMETKILTNARCLSEGVDVPALDSVIFFNPRNSMVDVVQSVGRVMRKSPGKNYGYIILPVAVPPGVAPSAALNDSRRFKVVWQVLNALRAHDDRFNAMVNSIALNEGNIKDLPVETEHTGPTSKDRDNAPYDSAESATQYVLFSLEQWQEAIYTKLVDKVGTRTYWEDWADDVADIAQAQITRIKALLDNASPTIKEEFERFVEGLRGNLNESISDDEAISMLSQHLITAPVFDALFAESSFAKQNPVSQVMQRMADALNSAELNSETEKLEKFYDSVRIRAAEVSSAAGKQAVIKDLYERFFKKAFKKQSEALGIVYTPVEIVDFILRAADDVSKKHFGRGLSDKDVHVLDPFTGTGTFMVRLLQSGLIKPEDLARKYANELHATEIMLLAYYVAAVNIETTYFGLEGERALRNGEDAPVYEPFDGIVLGDTFQMYEDDDKLDLDVFTANNDRMERQRLTPVQVIVGNPPYSVGQSSANDNNANLKYPTLDRRIEDSYAKYSTATNKNSLYDSYLRAFRWATDRIHTQGVVAFVSNNGWVDGNTADGVRLSLAQDFSEIYVFNLRGNSRTGGDLAKREGGNVFNVRVGTQIIVAVKNPQLSGCRILYKDIGDNLSADAKLNEIAVATIEGAEWQTISPNEYGDWISQRSVDFDTWPVLGDKKNKSALKVFQTFSAGLKTGRDAWCYGPTSAQVKTNITRLLETYEQAQQRFNSWVVDNGVTSPKEADVNQFLKQNPDLADSKKISWDSNLKMSLSRGDTFSFDPSSIQMSLYRPFFPQQTYFHVSLNQRRYQLPSMFPTPEHDNQGFYIVNPGSAKPFSTLATNLLPDLAMWGSNAGQFFTRWTWEPIETREGELDFGNGLFSTTPKKGVEGEILDGYRRVDNITDEILKLYQSSLGEDVTKDDIFYFVYAQLHDPAYREAYAADLKKMLPHIETPTDRARFDHFVTAGKELMDLHINYEDVEPWDVEVKVKEKADPTDRETWRVTKMKWAKVRDPETKKLVEDHTTLIYNSSITISGIPEEAENYQLGSRSAIAWLIDRYQVKKDKASGIVNDPNDWADEVGNPRYIVELIAKVTRVAVETMRIVEEL

SEQ ID NO: 6895 - protein, 169 aa, Corynebacterium glutamicum
MAVFDFPNPVNEYAARCTAGLVVLLSAATLFASGDLRIILASILTFGFALRVAGGPRYSPFGRLSVHVLVPLLKKAPILTPGPPKRFAQTIGLGFSGTSLILMAFGFNVAASVVLVMLIAAATLESVFGICLGCWGFGKLMRYGVIPEDVCEQCFQKESSRTGWLVSLK

SEQ ID NO: 6896 - protein, 120 aa, Corynebacterium glutamicum
MLEAEVLPLDLSPLWNKVHTIVSSIPAGHWASYGDVAVAAGTNAQSIGNHLAEHPVLNAHRVLRTDGSISDGFRWLNAEETRSPKEVLESEGVEFTSSNRANPQQRLTPEELLAFFAAEN

SEQ ID NO: 6897 - protein, 200 aa, Corynebacterium glutamicum
MTHLFLELDERLVLGVQQDGYQWTEHLFRLPLQHLRNSPNDLQGLKIRWCELYSTTGKDQGVELLPQATVVTPNNFEASTLSGLEKLETVEDLKEAARLIYEQGPQYVVVKGGMDFPGENAVDVLFDGSSYHVFSEPKIGEERVSGAGCTFAAVITAELAKGAEVVDAVATAKRVVTRAVQDAVASNAPFTSVWLAEDNK

SEQ ID NO: 6898 - protein, 81 aa, Corynebacterium glutamicum
MRERVLHLKGASDMALKNYTVEGMTCAHCVASVTEEVSEVNGVSAVDVTLESGNVAVSGEGFSDAEIQAAVEEAGYKIVAS

SEQ ID NO: 6899 - protein, 279 aa, Corynebacterium glutamicum
MLRRGVLFIVCASLFAIVQPAPTSMLGVGWRIPFLMAVPLGLIGWWIRTGAQENVRPASERPEAPIKQALRTEWKMMLRVGGFISCTGLSFYIFTTYMTTFLRSTVGLEGTLVLAGNIIALSMAAIVAPFVGRAIDKFPRRNIMAFATLSTVIMAIPAYIIAGQGTLTASLIAQVMLGIGAVTANCVTSVMMAEVFQEVTRGTSAGITYNVTYAIFGGSAPFISTALVSWTGSPLAPAVYMIIIALFAFTASRFIPETSPVFVTATPAIKAPKVLVNPG

SEQ ID NO: 6900 - protein, 319 aa, Corynebacterium glutamicum
MGIAGCSTASDEATSTSDDVAVGGRLFSTADSATAALGSDAEPGQFPRTVVHSRGETTLEQQPQRVVVLDSGEIDQVLSLGVTPVGIASPKDASSQPAYLENQLADVQTVGTTSELNFEAIAALKPDLILGSKLRVDESYDQLSQIAPTVLSIRPGFPWKENFLLTADALGLEGKAVEVLNEYQTHVDAVRETIDGSPEISLVRFMPGRTRLYGNLSFIGAILKDLGLSRPEIQNIDDLAVEISPENITDANGDWIFYSTYGKPEATEQDNILSNELWHNLPAVQEGHALEVNDESWFMGLGPLGANEVLDDIENILGS

SEQ ID NO: 6901 - protein, 374 aa, Corynebacterium glutamicum
MPVFGHNFLRLKSCIDLQVYCSAVTGEWKKYAWCSYSEPIFYCDERNTTMRAITHNTFGDPADVLQITEKEIPTPGPGQVRIQVTLATIHNHDLWTVKGSYGFVPDLPAAAGTEAVGIVDALGEGVEGLQVGQRVASGTSFGIWAEYALVDASGLIPVPEQLSDESAAQLVAMPFSAISLLDFLDMKPGEWLIQNSANGAVGRMLAQLAESRGIHVVGLVRRDAGVQELAAQNISGVVSTETPGWEKQVEDITGGASIAVALDSVGGSSAADLVKLLGEGGTLVSFGAMGNPIMEIPSGPVIFKHITVKGFWGSKVSREMPAEKKTQLFGELIARILDGTLTLPVDSTFDAADIVSAVRASSEPGRAGKVLIRF

SEQ ID NO: 6902 - protein, 128 aa, Corynebacterium glutamicum
MIIIGAVFAILAVLLHVFIFYMESFAWTSEKARGVFGTTEIDAENTKEMAYNQGFYNFFLAVIAGVGVAFLFAGSTGIGAALALAGTGSMLAAAAVLALSSPDKRGAAFKQGTFPLLAVVFLVIGLLV

SEQ ID NO: 6903 - protein, 73 aa, Corynebacterium glutamicum
MLQLVMSENSTPIFKVCTTAELRAERQELLERMRPFNLEQMHRLYDADLLSVEESEMLDNYRSLAWLIDGEIL

SEQ ID NO: 6904 - protein, 266 aa, Corynebacterium glutamicum
MVNYAFVIAGSEATGGAGIQVDLKTFQHLDVYGIGAITCLVAFDPKDNWNHRFVPVDAQVIANQIEAATAAHDLDVVKIGMLGTPATIDTVATALEENSFKHVVLDPVLICKGQEPGAALDTDTALRAKVLPQATVVTPNNFEATTLSGLDKLETIDDLKEAARLIHEQGPQYVVVKGGIDFPGDNAVDVLFDGTDYHVFSEPKIGDERVSGAGCTFAAVITAELAKGNSAVDAVTTAKRVVTRAVKDAVASNAPFTSVWLAEDNK

SEQ ID NO: 6905 - protein, 115 aa, Corynebacterium glutamicum
MSKTIIVRTEIEIPGHPTAIHIAEMQELPPSEAQGGVQMCKMQRIIELAGTAEGDVVTGAGVIGGSNFQLNNEPNEVVPHPDTYADFPDIKAVVISAETFEGLWLEAGAKFPGLN

SEQ ID NO: 6906 - protein, 67 aa, Corynebacterium glutamicum
MAIKNYTVEGMTCGHCVSSVKEEVGEVAGVTAVDVTLETGAVQVTGEDFTDEAVKAAVVEAGYKVVA

SEQ ID NO: 6907 - protein, 115 aa, Corynebacterium glutamicum
MSEFGLPEGVTLLNVAAVLIPIAIITLLLRIFPFAAMKRVNSNQLMGVLGRTMPVGVMVVLVIYTLFGQVSAPGGVGASLIAVAFTALLHWLKGSAGLSIVGGTLAYMFLVNVVF

SEQ ID NO: 6908 - protein, 237 aa, Corynebacterium glutamicum
MSSENLKEIRGGIGETLTVGLGLIPLGLAFGLLMVQTGFAWWWTPIFSFVIYAGSMEFLAIGMVTAGIGPFSAAVAGFMVNFRHIFYGLTFPRHRIKSGAGRAYSTYALTDESYAIVSARPPGDISGTRVLTVQILCQALWVIPGIIGALVGQVLPDDLKGMDFALTALFVVLAWEAFKNNKDYSLPLFAVVLALVSGFVAPEQMLVIALTTYFLILLLRVRFPNLDKKLEIRTSHE

SEQ ID NO: 6909 - protein, 189 aa, Corynebacterium glutamicum
MERNEVAPGMLLVAAPDMASEDFERSIVLIIEHSPATTFGVNISSRSDVAVANVLPEWVDLTSKPQALYIGGPLSQQAVVGLGVTKPGVDIENSTSFNKLANRLVHVDLRSAPEDVADDLEGMRFFAGYAEWAPGQLNEEIEQGDWFVTPALPSDIIAPGRVDIWGDVMRRQAMPLPLYSTFPSDPSDN

SEQ ID NO: 6910 - protein, 440 aa, Corynebacterium glutamicum
MVGGSVRDAFLGELGHDLDFTTSARPEETKAILDDYADVVWDTGIAFGTLSAEKHGQQIEITTFRSDLYDGNSRNPEVTFGDTLEGDLIRRDFKVNAMAVEIQADGELTFHDPVGGLEDLLTHTLDTPATPEQSFNDDPLRMLRAARFVSQLNFTLAPRVITAMTEMAQQITRITVERMQVELDKMILGKNPEAGIDLMVESGIAQIIYPEIPAMQMTQDEHMQHKDVYAHSLQVMRQAIDQEEDGPDLVLRWAALLHDCGKPDTRDFNEEGRVSFHQHEVVGAKLVRRRMRKLKYSKQMVGDVGQLVFLHMRFHGFSEGQWTDSAVRRYAADAGELLPRLHKLVRADCTTRNKRKAARLQATYDHLEERIAEIAAKEDLARVRPDLDGNEIMEILNIQAGPEVGKAWAFLKELRLERGPLDREVAIAELKSWWEGENNE

SEQ ID NO: 6911 - protein, 322 aa, Corynebacterium glutamicum
MSDLKPEGTTSGAPKRRRRRRSRRPSGQNQNPNQNRQGQQGQQTQNQPQAQPQSQQAQPQKQNQQGQNQGQASEKTSQRPKRRRSRRNPKSNNTQQHSQNSQNNQNSQNSQQNTQTQTSQSNKQKSQDNRRGKGRRSPTRRRSNTRVNQAWQQSRLVTSDETSAGGLVVSGLAEAVNANNEVDLSKIYVALIGRLDRRGRLLWSMPKGHVEPGEDKAATAEREVWEETGIHGEVFTELGVIDYWFVSEGKRIHKTVHHHLLRYVDGDLNDEDPEVTEVAWIPANQLIEHLAFADERKLARQAHDLLPEFALKEKAEGRSTPR

SEQ ID NO: 6912 - protein, 91 aa, Corynebacterium glutamicum
MGLGVLLGVLAVLVVLTVLAVLLGVVALRVPAGPTALWPLRGFLRSLALILALLVLLLGLGLLALWLGLGLILGLLPLLSLPVLVWVLVLT

SEQ ID NO: 6913 - protein, 837 aa, Corynebacterium glutamicum
MIPNPNPNPKAKTLRLVSALTAITVVGFSASPVHALPIPLDPSDPAVSELWVNPNARADDELSGVDVEISDFVMPNSNLTVQVGESFKAQVRVTNRSSETLSNITLQARRAEASFDMASARVAATDNNYGYFGAMVTLDDELEPGESVETEVEISTDSLSISQPGSYPTMLALSGQLDGVAQHLDSQRFLLPVLSDTTDTEDTATPTTMIYPISAQTNVLGGETGEAPEEPPLLVSSDALAGELDEGGRLQKLIDAYLQSSPAVQQATCLAIDPQLLDVVDRMTGGYTVTDTRPSTVRQNQRLRELWTADNQPTNGVAGTGAENAAIFLEKLRQATATSCTVALPWANADLNAVSQTGNQWLMREALQRGVTTFEEVLGVIPESNVVIPGNGFVEPSTVGDLGWAEVTLNPDQAWEVQSEELVAAPDATEQSALDNPKPTPGTVTPPTPMSTVSVLVSDNTVWRTTSADRFHSLAPGITGVSYQGSLSATLATLGQNPETVGYSNPDSRYDYAMDSESARNLTGQAALRLTVDNGDEDSPVLIMPSAVLGAEDGAMLLETTGALLADGSARPFSLQQYVTANAEQRNTLATATTPPDDTAFGAPYDDPASLTETEILRTTQQAEYIDDLTGIMSNDPSIALTRYGFTAPLRQDLLRALSISERRSLARHTQATSAADKLLNRNRDTLQKLRSSVALLPPGNVYTRTSESSPLLIVAQNGLPLPAETQILYSGNQDAHINTPGVVRIPAQGSITLQMTADLPDDNLRTDLTLWLASPDGATISEPVEITVQPRPNLGTTLFFVAAGILAVGGLLFIRKKRNVEKRSPGTGSPKPPPTH

SEQ ID NO: 6914 - protein, 1083 aa, Corynebacterium glutamicum
MPEARKKAVARTDGDRSSLKNSPTASATQAAQTRPAEPEPEKHTSDSDVVRSTGSMAIATLLSRITGFLRTVMIGAALSPAIASAFNTANTLPNLITEIVLGAVLTSLVIPVLTRAEKEDADGGSGFFRRLLTLSVTLLGGVTILSIIGAPLLTRMMLSSEGQVNVVMSTAFAYWLLPQIFFYGLFALFMAVLNTREVFKPGAWAPVVNNVITLTVLGVYMVLPARLHPHEQVGIFDPQIIFLGVGTTLGVVAQCLIMIPYLRRAGIDMRPLWGIDARLKQFGGMAMAIIVYVAISQFGYIITTRIASIADDAAPFIYQQHWMLLQVPYGIIGVTLLTAIMPRLSRNAADGDDRAVVSDLQLGSKLTFIALIPIVVFFTAFGVPIANGLFAYGQFDANAANILGWTLSFSAFTLIPYALVLLHLRVFYAREEVWTPTFIIAGITATKVVLSLLAPLLSSSPERVVVLLGAANGFSFITGAVIGAYLLRNKLGLLGMRSLAKTSLWALGSAAVGAAAAWALGWLIQAVVGDFLLGTLSSVGYLLYLAVLGVFFIFVTGIVLSRSGLPEVQNLGQALTRIPGLSRFIRPNTKISLDVGEVSEQDFSTQLVAPSEFAATPVPPPMSAGIVRGPRLVPGAPVGDGRFRLLADHGGVQGARFWQAREIATGKEVALIFVDTSGNAPFAPLSSAAAAGIAYEVQRRTKKLASLGSLAVAPNIHSEAYRNGCLIVADWVPGSSLSAVAESGADPRAAAFALAELTETIGEAHEMGIPAGLDNKCRIRINTDGHAVLAFPAILPDASELRDAKSLASAAEMLIDATLAPSDVKAMVTEAQGLATEDNPDYASLAMAMRTCGLFTEEPTHLVVKKEKTPKPATRDGFGASDYTVKGMAAIAAVVIILVSLVAAGTAFLTSFFGSSTNEQSPLASVEATTSATPEPVGPPVYLDLDQARTWDDGAGTDVTDVTDGNTSTAWTSTGGDGLLVDLSTPARLDRVILTTGTGSDSNVTSTVKIYAFNDASPHSLSEGIEIGTVDYSGRSLSHSIRDSSKLPGQVESVVILVDEVRSSQTSDTNPQMQIAEVQLVGW

SEQ ID NO: 6915 - protein, 241 aa, Corynebacterium glutamicum
MGVGVADSSRRGRFLAGHSKLRRLLVVPGCVGCLLHLRHRHRVVTFWFAGGPKLGPGTDPHPRFEPVYSPEYQDLFGCRRSLRAGFLHPAGRAKRVRSNPCAATDVRRYCPRTSPGSRRPSRRRSFPSARRSRRRPRRAFLAGPRDRHRQGSRADLCGYFRQRPICATVFGSRSGHRLRGAAPHQEAGQLGQLGGSPQHPLRGVPQRLPHCGRLGAWLQLERRRGIRCRSPRRRVRARGTN

SEQ ID NO: 6916 - protein, 201 aa, Corynebacterium glutamicum
MTVLPKNHDLSDTQLVKQFISGDSRAFSTIIHRHERHMMQAARKYGRKPEDAQDILQEALFRASRNMHLYRAEAALGTWLHKLVLNSGFDWATHRSQVEFPILNEPTIDLEKDPRLATDPLGYLDVAMTIRSAIDQLHPDQRIALILVDLGGYTVEDVAEIEGIKVGTVKSRRGRARKALRALLHADFFGPEDGSIQCESN

SEQ ID NO: 6917 - protein, 317 aa, Corynebacterium glutamicum
MSEEQSAVAPKIHDVAIIGSGPAGYTAAVYAARADLNPIMFEGYEYGGSLMTTTDVENFPGFEKGILGPELMENMRAQAERFGTDMHMELVDRVDLTGDIKKLWVGDDEYHARAVILSMGSAPRYLGVKGEQELLGRGVSACATCDGFFFRDQDIAVIGGGDSAMEEATFLTKFARSVTIVHRREEFRASAIMLERAQKNEKIRFVTNKTVEEVIEADGKVSGLKLNDTVTGEDSVLDVTAMFVAIGHDPRSEILAGQVEVDPSNYVLVQEPSTRTNLDGVFAAGDLVDSHYQQAITAAGSGCRAAIDAEHYLASLA

SEQ ID NO: 6918 - protein, 395 aa, Corynebacterium glutamicum
MLCIDRCAATGTSCGDGLLVVAVHQVASSENTIKVGAGGRLLNQNVVGRINLDLTCEDFRAWIMADGNEHGGDIQDGIFTSDGVVELQTADLAVCLDDLFDSLVGDEANLLVLLSTLQHDGAGAELFAAVHDGDTASELGEEGCFLHRGVATTDHGDVLIAEEETIAGCTCRNAAAEQFLLALHTQVARCRTHGQDDSTRVVLIVADPQLLDVAGEINAVDKLHVHVGAETLGLSAHVFHELWAQDSLFKAWEVFHVSSGHQRSTVFIALEHDGVEVSAGCIYCCGIASWTGADDGDIMNLWCYGRLFFRHCFPQSSKRKSAASRAPFTLVVNSPFSTSDTLKNFHQLLSHCMEPSSGPKKSACKRARNALRARPRRDLTVPTLIPSISATSSTV

SEQ ID NO: 6919 - protein, 124 aa, Corynebacterium glutamicum
MNVGFPRSPVIVNLGETMSNVVAVTEQTFKSTVIDSDKPVIVDFWAEWCGPCKKLSPIIEEIAGEYGDKAVVASVDVDAERTLGAMFQIMSIPSVLIFKNGAKVEEFVGLRPKNEIVEKLEKHL

SEQ ID NO: 6920 - protein, 414 aa, Corynebacterium glutamicum
MDELYPLIILNMNDGRSRVSKVLRVGDRSPRVAEVRTTLARLGVIEGYSREMSAKTESQKFHEEETLFDEELSLSIKSFQQARGVVPSGLIDDPTLRAIREASYTLGTRVLAYQPGNQLVGDDVVEIQSHLQELGFYADRVDGHFGELTHKAVMNYQLNYGMQVDGICGPDTIRALSRLGLRIKGGSAQAIRERERMRNAGPRLAGKRVVIDPALGGSNKGQIVKGPYGEISEEEILWDLATRLEGRMIATGMETILSRPHMDDPSSRDRASIANAFGADLMLSLHCDSYPNEKANGVASFYFGSENGTNSLTGETLSAYIQKEIVARTPLNNCGSHARTWDLLRLTRMPMVEVVTGYLTNPDDLAVLTDPQMRDHIAEAIVVAVKRLYLLDEEAQPKTGTFKFSELLQSEQAG

SEQ ID NO: 6921 - protein, 259 aa, Corynebacterium glutamicum
MAATVVQWGAGNDLFLDVRGERFTGQGVGAVFRTEVEAGHAVSFFIRVGIAVQAQHEVSAESIRDRRAITAAGIIHVRARQNGFHACCDHATFQAGGQIPEDFFLRDLTVGAFHDLTLVGAPKRRINDHTLASKTWACIAHAFAFTDSLSRATLDAQTKSGQRTDGVRATDAVYLHAVVELVVHHSFVCELAKMSIHTVGVEAELLEMGLDFYNVVTNKLVAGLVGQHAGSQGVGGFADCAQGGVVNKPGGNDSSSLLE

SEQ ID NO: 6922 - protein, 347 aa, Corynebacterium glutamicum
MLKPQDSYSSSVVDSQASFSNTGSALAATSGASSQNTDLRAWGCRKSMCSCTIGKREAWSMAPNLKLLALDQGHDALEIILVAEFHHELALLLTHHHRDLGIQIIRQGLSRTGKDLRSCSLFAWLLLLILITTVVQQHQFLSSTHRQALSDDSGRQGVLSILAGLEPQQCACMACRQHTGCHLGLHVDWKAQQTNHIGDYRTGTAQLIGQLCLGDTELLQQLLVGGCLFQRIQLHPVDIFQKGVAQHRAVFSFTDNRRDNLKASSLGCTPTTLTHDELIAILGPAHHDRLHEAELADRMHQLVKCLRIKLMARLLRVGADLLDRDLKVGCAELRLLCWLCLRRFLLC

SEQ ID NO: 6923 - protein, 206 aa, Corynebacterium glutamicum
MLQASLFPIVQEHIDFLHPQARKSVFWELAPEVAAKADPVFEKEAWLSTTLLEYESCGFNIGYRNGTPALASVIFCERDAAPGAKALPTAPVSSDAAIISSLFIDEVFRGTGMESALLDASLMELIRRDYPAVEAFGYRSENTEADAIAARRLEIGLIDVEALESAGFEVVADHPVLPRLRMELPPATVLLTAKDAQRLLQEMGAI

SEQ ID NO: 6924 - protein, 384 aa, Corynebacterium glutamicum
MRLRAMAQNKGSDKSQTEKRKGGLGRGLAALIPSGPSNSPGLGGGAADIILGGTVGARTAAAPKRESTPAAPAPEAPAQAAPQHTEATKPEVVPEPAAPAPTQSAQQEAPQAQPAQQSEFGASYLEIPIEQIRPNPQQPRHEFDPQALDELVHSISEFGLMQPIVVRRSEDGYELIMGERRWRASKRAGLEVIPAIVRETEDSAMLRDALLENIHRVQLNPLEEAAAYQQLLEEFGVTQAELADKLGRSRPVITNMIRLLGLPVNVQTKVAAGVLSAGHARALLGLKAGEDAQDTLATRIIAEGLSVRATEELVLLHNRGDQDEEKKPREKAATPEVFTRAAESLADNLDTKVSVMMGKKKGKLVVEFGDKDDFERIMSLIQGQ

SEQ ID NO: 6925 - protein, 279 aa, Corynebacterium glutamicum
MPKPKEPRLITIANQKGGVGKTTSTVNLAASLAIHGLKVLVVDLDPQGNASTALGVEHRSGTLSSYELLIGECTADEAMQPSTANENLFCIPATLDLAGAEIELVSLVRREYRLADALGREFIDKHDFDYMIIDCPPSLGLLTINAMTAVNEVLIPIQCEYYALEGVGQLLNNITMLRQHLNRQLHISAILLTMYDARTNLAEQVATEVNDHFGDVVLGNKIPRSVKVSEAPGYGQTVIEYDPGSRGAMAYLDAAKELATRGDYLPSDESGPIGLKPAK

SEQ ID NO: 6926 - protein, 223 aa, Corynebacterium glutamicum
MLYRSISCPKGTFFMTTPPAAAEIFGDNLEKAIAYHESLATDGSVRGFIGPREVPRLWDRHILNCGVIGEAMDEGISVADIGSGAGLPGIPLAIARPDLNITLIEPLLKRSVYLNEVKEALNLDNVTVVRGRAEEKVVRKQVGLVDIVTSRAVAPLGKLATWSLPLVKIGGRMVAMKGSSVEEEIERDAKEIRKAGGTDIKVYTVGEALLSEPTTLISIRREK

SEQ ID NO: 6927 - protein, 317 aa, Corynebacterium glutamicum
MLNFIYWPISAILWFWHKAFSFVLSPDSGITWALSIMFLTFTVRMVLVKPMVNTMRSQRKMQDMAPKMQAIREKYKNDQQKMMEETRKLQKEVGVNPIAGCLPMLVQIPVFLGLFHVLRSFNRTGSGVGQLEMTVEQNANTPNYIFGVDEVQSFLRADLFGAPLSSYITMPADAFDAFLGLDVSRLNIALVAAPMILIIVVATHMNARLSVNRQEARKAAGKQQAASSDQMAMQMQMMNKMMLWFMPATILFTGFIWTIGLLVYMMSNNVWTFFQQRYIFAKMDAEEAAEEEEKRAAKRTTAPKPGVKPENPKKRKK

SEQ ID NO: 6928 - protein, 133 aa, Corynebacterium glutamicum
MLPAQHKLNSSMQFRTVMRKGRRAGSKTVVVHLWDSAESLDGTEKQGEVASFGGPRFGLVVSKAVGNAVVRHRTSRRLRHICASIAEKSPELLSPTHHVVIRALAGAGNATSAELERDIRYGLGKASRVRTNK

SEQ ID NO: 6929 - protein, 112 aa, Corynebacterium glutamicum
MCLRATLSIKRCCGFIHESAISKKIIQRWVIRSPGIGLARKSSRTLSTRTGVSGDPSTKYLGVFHMAKGKRTFQPNNRRRARVHGFRLRMRTRAGRAIVAARRRKGRAKLTA

SEQ ID NO: 6930 - protein, 98 aa, Corynebacterium glutamicum
MHTASTACENFNLWITGNVHLEIKGNIQITAGESEFEVDAHFPQVVRYPVDKRFWEKLSTAVDNIVETMVMGVFRCEWSCRNIENAHVDNKAEFCPAF

SEQ ID NO: 6931 - protein, 74 aa, Corynebacterium glutamicum
MMLCAIFIVTRSSIHMSNPCEFFAEWSLPEGGVEKRLDGRYALSPVFNASFVITGAPAELPKDRFVFAGRFPVS

SEQ ID NO: 6932 - protein, 136 aa, Corynebacterium glutamicum
MLRTILGSKIHRATVTQADLDYVGSVTIDADLVHAAGLIEGEKVAIVDITNGARLETYVIVGDAGTGNICINGAAAHLINPGDLVIIMSYLQATDAEAKAYEPKIVHVDADNRIVALGNDLAEALPGSGLLTSRSI

SEQ ID NO: 6933 - protein, 616 aa, Corynebacterium glutamicum
MSPNDAFISAPAKIETPVGPRNEGQPAWNKQRGSSMPVNRYMPFEVEVEDISLPDRTWPDKKITVAPQWCAVDLRDGNQALIDPMSPERKRRMFELLVQMGFKEIEVGFPSASQTDFDFVREIIEKGMIPDDVTIQVLVQAREHLIRRTFEACEGAKNVIVHFYNSTSILQRNVVFRMDKVQVKKLATDAAELIKTIAQDYPDTNWRWQYSPESFTGTEVEYAKEVVDAVVEVMDPTPENPMIINLPSTVEMITPNVYADSIEWMHRNLNRRDSIILSLHPHNDRGTGVGAAELGYMAGADRIEGCLFGNGERTGNVCLVTLALNMLTQGVDPQLDFTDIRQIRSTVEYCNQLRVPERHPYGGDLVFTAFSGSHQDAVNKGLDAMAAKVQPGASSTEVSWEQLRDTEWEVPYLPIDPKDVGRDYEAVIRVNSQSGKGGVAYIMKTDHGLQIPRSMQVEFSTVVQNVTDAEGGEVNSKAMWDIFATEYLERTAPVEQIALRVENAQTENEDASITAELIHNGKDVTVDGRGNGPLAAYANALEKLGIDVEIQEYNQHARTSGDDAEAAAYVLAEVNGRKVWGVGIAGSITYASLKAVTSAVNRALDVNHEAVLAGGV

SEQ ID NO: 6934 - protein, 85 aa, Corynebacterium glutamicum
MGHRGQTPDRAPHPKRWLPKELTFTQCSDDTDVVGRHEYRDAGIFLTNSSTWFRHPLGSATSACPVADVHAAALSTIQWLPTTPN

SEQ ID NO: 6935 - protein, 344 aa, Corynebacterium glutamicum
MTTIAVVGATGQVGQVMRTLLEERNFPADTVRFFASPRSAGRKIEFRGTEIEVEDITQATEESLKDIDVALFSAGGTASKQYAPLFAAAGATVVDNSSAWRKDDEVPLIVSEVNPSDKDSLVKGIIANPNCTTMAAMPVLKPLHDAAGLVKLHVSSYQAVSGSGLAGVETLAKQVAAVGDHNVEFVHDGQAADAGDVGPYVSPIAYNVLPFAGNLVDDGTFETDEEQKLRNESRKILGLPDLKVSGTCVRVPVFTGHTLTIHAEFDKAITVDQAQEILGAASGVKLVDVPTPLAAAGIDESLVGRIRQDSTVDDNRGLVLVVSGDNLRKGAALNTIQIAELLVK

SEQ ID NO: 6936 - protein, 149 aa, Corynebacterium glutamicum
MEPKMPGKILLLNGPNLNMLGKREPDIYGHDTLEDVVALATAEAAKHGLEVEALQSNHEGELIDALHNARGTHIGCVINPGGLTHTSVALLDAVKASELPTVEVHISNPHAREEFRHHSYISLAAVSVIAGAGIQGYRFAVDILANLKK

SEQ ID NO: 6937 - protein, 396 aa, Corynebacterium glutamicum
MAKAKFERTKPHVNIGTIGHVDHGKTTTTAAITKVLADTYPELNEAFAFDSIDKAPEEKERGITINISHVEYQTEKRHYAHVDAPGHADYIKNMITGAAQMDGAILVVAATDGPMPQTREHVLLARQVGVPYILVALNKCDMVEDEEIIELVEMEVRELLAEQDYDEEAPIVHISALKALEGDEKWGKQILELMQACDDNIPDPVRETDKPFLMPIEDIFTITGRGTVVTGRVERGTLNVNDDVDIIGIKEKSTSTTVTGIEMFRKLLDSAEAGDNCGLLLRGIKREDVERGQVIVKPGAYTPHTEFEGSVYVLSKDEGGRHTPFFDNYRPQFYFRTTDVTGVVKLPEGTEMVMPGDNVDMSVTLIQPVAMDEGLRFAIREGSRTVGAGRVTKIIK

SEQ ID NO: 6938 - protein, 440 aa, Corynebacterium glutamicum
MSAIIQAFKDADLRKKIFFTIAMIVLYRIGAQIPSPGVDYATISGRLRDLTQDQSSVYSLINLFSGGALLQLSIFAIGIMPYITASIIVQLLTVVIPHFEELKKEGQSGQAKMMQYTRYLTVALALLQSSGIVALADREQLLGAGIRVLSADRNFFDLIVLVITMTAGAVLVMWMGELITEKGVGNGMSLLIFAGIATRLPTDGMNILGNSGGVVFAVVLASVLILVIGVVFVEQGQRRIPVQYAKRMVGRRQYGGSSTYLPLKVNQAGVIPVIFASSLIYMPVLITQIVNSGSLEVSDNWWQRNIIAHLQTPSSWQYIVLYFALTIFFSYFYVSVQYDPAEQAENMKKYGGFIPGIRPGRPTAEYLGFVMNRLLFVGSLYLAVIAVLPNIMLDLGVDAGSAGATPFGGTAILILVSVALTTVKQIESQLLQSNYEGLLK

SEQ ID NO: 6939 - protein, 738 aa, Corynebacterium glutamicum
MAKIIWTRTDEAPLLATYSLKPVVEAFAATAGIEVETRDISLAGRILAQFPERLTEDQKVGNALAELGELAKTPEANIIKLPNISASVPQLKAAIKELQDQGYDIPELPDNATTDEEKDILARYNAVKGSAVNPVLREGNSDRRAPIAVKNFVKKFPHRMGEWSADSKTNVATMDANDFRHNEKSIILDAADEVQIKHIAADGTETILKDSLKLLEGEVLDGTVLSAKALDAFLLEQVARAKAEGILFSAHLKATMMKVSDPIIFGHVVRAYFADVFAQYGEQLLAAGLNGENGLAAILSGLESLDNGEEIKAAFEKGLEDGPDLAMVNSARGITNLHVPSDVIVDASMPAMIRTSGHMWNKDDQEQDTLAIIPDSSYAGVYQTVIEDCRKNGAFDPTTMGTVPNVGLMAQKAEEYGSHDKTFRIEADGVVQVVSSNGDVLIEHDVEANDIWRACQVKDAPIQDWVKLAVTRSRLSGMPAVFWLDPERAHDRNLASLVEKYLADHDTEGLDIQILSPVEATQLSIDRIRRGEDTISVTGNVLRDYNTDLFPILELGTSAKMLSVVPLMAGGGLFETGAGGSAPKHVQQVQEENHLRWDSLGEFLALAESFRHELNNNGNTKAGVLADALDKATEKLLNEEKSPSRKVGEIDNRGSHFWLTKFWADELAAQTEDADLAATFAPVAEALNTGAADIDAALLAVQGGATDLGGYYSPNEEKLTNIMRPVAQFNEIVDALKK

SEQ ID NO: 6940 - protein, 591 aa, Corynebacterium glutamicum
MSVETRKITKVLVANRGEIAIRVFRAARDEGIGSVAVYAEPDADAPFVSYADEAFALGGQTSAESYLVIDKIIDAARKSGADAIHPGYGFLAENADFAEAVINEGLIWIGPSPESIRSLGDKVTARHIADTAKAPMAPGTKEPVKDAAEVVAFAEEFGLPIAIKAAFGGGGRGMKVAYKMEEVADLFESATREATAAFGRGECFVERYLDKARHVEAQVIADKHGNVVVAGTRDCSLQRRFQKLVEEAPAPFLTDDQRERLHSSAKAICKEAGYYGAGTVEYLVGSDGLISFLEVNTRLQVEHPVTEETTGIDLVREMFRIAEGHELSIKEDPAPRGHAFEFRINGEDAGSNFMPAPGKITSYREPQGPGVRMDSGVVEGSEISGQFDSMLAKLIVWGDTREQALQRSRRALAEYVVEGMPTVIPFHQHIVENPAFVGNDEGFEIYTKWIEEVWDNPIAPYVDASELDEDEDKTPAQKVVVEINGRRVEVALPGDLALGGTAGPKKKAKKRRAGGAKAGVSGDAVAAPMQGTVIKVNVEEGAEVNEGDTVVVLEAMKMENPVKAHKSGTVTGLTVAAGEGVNKGVVLLEIK

SEQ ID NO: 6941 - protein, 437 aa, Corynebacterium glutamicum [sequence omitted]

SEQ ID NO: 6942 - protein, 118 aa, Corynebacterium glutamicum
MEKPQIELPVGPAPEDLVISDIIVGEGAEARPGGEVEVHYVGVDFETGEEFDSSWDRGQTSQFPLNGLIAGWQEGIPGMKVGGRRQLTIPPEAAYGPEGSGHPLSGRTLVFIIDLISA

SEQ ID NO: 6943 - protein, 595 aa, Corynebacterium glutamicum
MTTSDPNPKPIVEDAQPEQITATEELAGLLENPTNLEGKLADAEEEIILEGEDTQASLNWSVIVPALVIVLATVVWGIGFKDSFTNFASSALSAVVDNLGWAFILFGTVFVFFIVVIAASKFGTIRLGRIDEAPEFRTVSWISMMFAAGMGIGLMFYGTTEPLTFYRNGVPGHDEHNVGVAMSTTMFHWTLHPWAIYAIVGLAIAYSTFRVGRKQLLSSAFVPLIGEKGAEGWLGKLIDILAIIATVFGTACSLGLGALQIGAGLSAANIIEDPSDWTIVGIVSVLTLAFIFSAISGVGKGIQYLSNANMVLAALLAIFVFVVGPTVSILNLLPGSIGNYLSNFFQMAGRTAMSADGTAGEWLGSWTIFYWAWWISWSPFVGMFLARISRGRSIREFILGVLLVPAGVSTVWFSIFGGTAIVFEQNGESIWGDGAAEEQLFGLLHALPGGQIMGIIAMILLGTFFITSADSASTVMGTMSQHGQLEANKWVTAAWGVATAAIGLTLLLSGGDNALSNLQNVTIVAATPFLFVVIGLMFALVKDLSNDVIYLEYREQQRFNARLARERRVHNEHRKRELAAKRRRERKASGAGKRR

SEQ ID NO: 6944 - protein, 426 aa, Corynebacterium glutamicum
MNEWRTVSLVDSTALTVIISVAVFTSAVALLGVVKKRSRWRVLGALISSAVLTSGAWVVIEKLWKPFPDPNPWTIYLSAGLAVFPLLSILFRTGRTRILMATLTVIALVNTAAVINVIYQPYPTLGSFNPVPTAVSMSYADFESQTTAPTMDDREVGALVQVPLAGTTDDSTSGFDARDAYAYIPPAYWDNPSLQLPVLVLMPGNPGQPDQWFSSGNADQTADNFQATHDGISPIVISVDGTGSFSGNPACVDSDAQSVMTYLSHDVPMLIKQKFRVNQDQRTWTIGGLSYGGTCALQIMTNHPEAYGSFLDFSGQEEPTLGTRQQTVDQLFGGDEDAFKAVNPEDLLNQAISSGAHTYSGISGRFIAGSNDKSAVSALSHLDNLSNQAGMSTTFDTVAGGHSFQVWRVALANTFDWVAKRGGLQV

SEQ ID NO: 6945 - protein, 501 aa, Corynebacterium glutamicum
MNTQSDSAGSQGAAATSRTVSIRTLIALIIGSTVGAGIFSIPQNIGSVAGPGAMLIGWLIAGVGMLSVAFVFHVLARRKPHLDSGVYAYARVGLGDYVGFSSAWGYWLGSVIAQVGYATLFFSTLGHYVPLFSQDHPFVSALAVSALTWLVFGVVSRGISQAAFLTTVTTVAKILPLLCFIILVAFLGFSWEKFTVDLWARDGGVGSIFDQVRGIMVYTVWVFIGIEGASVYSRQARSRSDVSRATVIGFVAVLLLLVSISSLSFGVLTQQELAALPDNSMASVLEAVVGPWGAALISLGLCLSVLGAYVSWQMLCAEPLALMAMDGLIPSKIGAINSRGAAWMAQLISTIVIQIFIIIFFLNETTYVSMVQLATNLYLVPYLFSAFYLVMLATRGKGITHPHAGTRFDDSGPEISRRENRKHLIVGLVATVYSVWLFYAAEPQFVLFGAMAMLPGLIPYVWTRIYRGEQVFNRFEIGVVVVLVVAASAGVIGLVNGSLSL

SEQ ID NO: 6946 - protein, 463 aa, Corynebacterium glutamicum
MAKSNEGLGTGLRTRHLTMMGLGSAIGAGLFLGTGVGIRAAGPAVLLAYIIAGAIVVLVMQMLGEMAAARPASGSFSRYGEDAFGHWAGFSLGWLYWFMLIMVMGAEMTGAAAIMGAWFGVEPWIPSLVCVVFFAVVNLVAVRGFGEFEYWFAFIKVAVIIAFLIIGIALIFGWLPGSTFVGTSNFIGDHGFMPNGISGVAAGLLAVAFAFGGIEIVTIAAAESDKPREAISLAVRAVIWRISVFYLGSVLVITFLMPYESINGADTAAESPFTQILAMANIPGTVGFMEAIIVLALLSAFNAQIYATSRLVFSMANRQDAPRVFSKLSTSHVPTNAVLLSMFFAFVSVGLQYWNPAGLLDFLLNAVGGCLIVVWAMITLSQLKLRKELQANDEISTVRMWAHPWLGILTLVLLAGLVALMLGDAASRSQVYSVAIVYGFLVLLSFVTVNSPLRGGRTPSDLN

SEQ ID NO: 6947 - protein, 316 aa, Corynebacterium glutamicum
MSENIRGAQAVGIANIAMDGTILDTWYPEPQIFNPDQWAERYPLEVGTTRLGANELTPRMLQLVKLDQDRLVEQVAVRTVIPDLSQPPVDAHDVYLRLHLLSHRLVRPHEMHMQNTLELLSDVVWTNKGPCLPENFEWVRGALRSRGLIHVYCVDRLPRMVDYVVPPGVRISEAERVRLGAYLAPGTSVLREGFVSFNSGTLGAAKVEGRLSSGVVIGEGSEIGLSSTIQSPRDEQRRRLPLSIGQNCNFGVSSGIIGVSLGDNCDIGNNIVLDGDTPIWFAADEELRTIDSIEGQANWSIKRESGFHEPVARLKA

SEQ ID NO: 6948 - protein, 369 aa, Corynebacterium glutamicum
MNSELKPGLDLLGDPIVLTQRLVDIPSPSGQEKQIADEIEDALRNLNLPGVEVFRFNNNVLARTNRGLASRVMLAGHIDTVPIADNLPSRVEDGIMYGCGTVDMKSGLAVYLHTFATLATSTELKHDLTLIAYECEEVADHLNGLGHIRDEHPEWLAADLALLGEPTGGWIEAGCQGNLRIKVTAHGVRAHSARSWLGDNAMHKLSPIISKVAAYKAAEVNIDGLTYREGLNIVFCESGVANNVIPDLAWMNLNFRFAPNRDLNEAIEHVVETLELDGQDGIEWAVEDGAGGALPGLGQQVTSGLIDAVGREKIRAKFGWTDVSRFSAMGIPALNFGAGDPSFAHKRDEQCPVEQITDVAAILKQYLSE

SEQ ID NO: 6949 - protein, 524 aa, Corynebacterium glutamicum
MSDNTWFIIAIVIYMLVMVLIGYWSYRKTEKYDDYMLAGRGLNPFVAAMSAGASDMSGWLLMGLPGALFVTGMSELWIAVGLTIGAWANWMWVAPRLRSYSEISANSITLPSFFENRLRDKSRALRIIAALIIIVFFTFYISSGMVAGGVYWESTFGGDYLLGMAIVAGVTVLYTFIGGFLAVSYTDAVQGTIMFFSLIIVPVMAYFALANPMDIWSFANSNDYGPHTDGIGNPTYFSMISGISAAAIIGNLGWGLGYFGQPHIVVRFMALRTPAEAKQGRRIGISWMIICLIGATFTAIISTVFFAQNPDANITDTRAYESIFLDLARMLFHPLIAGLILTAVLAAIMSTMSSQLLVTASSLIEDLLKVVKKDSLSERTLIMLSRATVIILAIIAAAMAINPSDSILGLVGFAWAGFGSAFGPIILASLYWKRLNAAGAISGMITGAIVSIAWGMSPLSDTLYEIIPGFALATIVMVVVSLLTKEPSEEILNEFETAKDLAAAVESNEDVDFADAAQKLSKES

SEQ ID NO: 6950 - protein, 550 aa, Corynebacterium glutamicum
MTPADLATLIKETAVEVLTSRELDTSVLPEQVVVERPRNPEHGDYATNIALQVAKKVGQNPRDLATWLAEALAADDAIDSAEIAGPGFLNIRLAAAAQGEIVAKILAQGETFGNSDHLSHLDVNLEFVSANPTGPIHLGGTRWAAVGDSLGRVLEASGAKVTREYYFNDHGRQIDRFALSLLAAAKGEPTPEDGYGGEYIKEIAEAIVEKHPEALALEPAATQELFRAEGVEMMFEHIKSSLHEFGTDFDVYYHENSLFESGAVDKAVQVLKDNGNLYENEGAWWLRSTEFGDDKDRVVIKSDGDAAYIAGDIAYVADKFSRGHNLNIYMLGADHHGYIARLKAAAAALGYKPEGVEVLIGQMVNLLRDGKAVRMSKRAGTVVTLDDLVEAIGIDAARYSLIRSSVDSSLDIDLGLWESQSSDNPVYYVQYGHARLCSIARKAETLGVTEEGADLSLLTHDREGDLIRTLGEFPAVVKAAADLREPHRIARYAEELAGTFHRFYDSCHILPKVDEDTAPIHTARLALAAATRQTLANALHLVGVSAPEKM

SEQ ID NO: 6951 - protein, 445 aa, Corynebacterium glutamicum
MATVENFNELPAHVWPRNAVRQEDGVVTVAGVPLPDLAEEYGTPLFVVDEDDFRSRCRDMATAFGGPGNVHYASKAFLTKTIARWVDEEGLALDIASINELGIALAAGFPASRITAHGNNKGVEFLRALVQNGVGHVVLDSAQELELLDYVAAGEGKIQDVLIRVKPGIEAHTHEFIATSHEDQKFGFSLASGSAFEAAKAANNAENLNLVGLHCHVGSQVFDAEGFKLAAERVLGLYSQIHSELGVALPELDLGGGYGIAYTAAEEPLNVAEVASDLLTAVGKMAAELGIDAPTVLVEPGRAIAGPSTVTIYEVGTTKDVHVDDDKTRRYIAVDGGMSDNIRPALYGSEYDARVVSRFAEGDPVSTRIVGSHCESGDILINDEIYPSDITSGDFLALAATGAYCYAMSSRYNAFTRPAVVSVRAGSSRLMLRRETLDDILSLEA

SEQ ID NO: 6952 - protein, 445 aa, Corynebacterium glutamicum
MTSASAPSFNPGKGPGSAVGIALLGFGTVGTEVMRLMTEYGDELAHRIGGPLEVRGIAVSDISKPREGVAPELLTEDAFALIEREDVDIVVEVIGGIEYPREVVLAALKAGKSVVTANKALVAAHSAELADAAEAANVDLYFEAAVAGAIPVVGPLRRSLAGDQIQSVMGIVNGTTNFILDAMDSTGADYADSLAEATRLGYAEADPTADVEGHDAASKAAILASIAFHTRVTADDVYCEGISNISAADIEAAQQAGHTIKLLAICEKFTNKEGKSAISARVHPTLLPVSHPLASVNKSFNAIFVEAEAAGRLMFYGNGAGGAPTASAVLGDVVGAARNKVHGGRAPGESTYANLPIADFGETTTRYHLDMDVEDRVGVLAELASLFSEQGISLRTIRQEERDDDARLIVVTHSALESDLSRTVELLKAKPVVKAINSVIRLERD

SEQ ID NO: 6953 - protein, 309 aa, Corynebacterium glutamicum
MAIELNVGRKVTVTVPGSSANLGPGFDTLGLALSVYDTVEVEIIPSGLEVEVFGEGQGEVPLDGSHLVVKAIRAGLKAADAEVPGLRVVCHNNIPQSRGLGSSAAAAVAGVAAANGLADFPLTQEQIVQLSSAFEGHPDNAAASVLGGAVVSWTNLSIDGKSQPQYAAVPLEVQDNIRATALVPNFHASTEAVRRVLPTEVTHIDARFNVSRVAVMIVALQQRPDLLWEGTRDRLHQPYRAEVLPITSEWVNRLRNRGYAAYLSGAGPTAMVLSTEPIPDKVLEDARESGIKVLELEVAGPVKVEVNQP

SEQ ID NO: 6954 - protein, 209 aa, Corynebacterium glutamicum
MYALRDIVASGKALYVGISSYGPELTAEAAEFMAEEGCPLLIHQPSYSIINRWVEEPGDDGENLLQSAANNGLGVIAFSPLAQGLLTDKYLDGIPEGSRASQGKSLSEGMLNVNNIDMVRKLNDIAQERGQSLAQMALAWVLREQGEYGADTVTSALIGASSVEQLDNSLDSLNNLEFSDAELEAIDEISHDAGINIWAKATDSKTREN

SEQ ID NO: 6955 - protein, 236 aa, Corynebacterium glutamicum
MVIMEIFITGLLLGASLLLSIGPQNVLVIKQGIKREGLIAVLLVCLISDVFLFIAGTLGVDLLSNAAPIVLDIMRWGGIAYLLWFAVMAAKDAMTNKVEAPQIIEETEPTVPDDTPLGGSAVATDTRNRVRVEVSVDKQRVWVKPMLMAIVLTWLNPNAYLDAFVFIGGVGAQYGDTGRWIFAAGAFAASLIWFPLVGFGAAALSRPLSSPKVWRWINVVVAVVMTALAIKLMLMG

SEQ ID NO: 6956 - protein, 290 aa, Corynebacterium glutamicum
MNPIQLDTLLSIIDEGSFEGASLALSISPSAVSQRVKALEHHVGRVLVSRTQPAKATEAGEVLVQAARKMVLLQAETKAQLSGRLAEIPLTIAINADSLSTWFPPVFNEVASWGGATLTLRLEDEAHTLSLLRRGDVLGAVTREANPVAGCEVVELGTMRHLAIATPSLRDAYMVDGKLDWAAMPVLRFGPKDVLQDRDLDGRVDGPVGRRRVSIVPSAEGFGEAIRRGLGWGLLPETQAAPMLKAGEVILLDEIPIDTPMYWQRWRLESRSLARLTDAVVDAAIEGLRP

SEQ ID NO: 6957 - protein, 626 aa, Corynebacterium glutamicum
MNVAASQQPTPATVASRGRSAAPERMTGAKAIVRSLEELNADIVFGIPGGAVLPVYDPLYSSTKVRHVLVRHEQGAGHAATGYAQVTGRVGVCIATSGPGATNLVTPIADANLDSVPMVAITGQVGSGLLGTDAFQEADIRGITMPVTKHNFMVTNPNDIPQALAEAFHLAITGRPGPVLVDIPKDVQNAELDFVWPPKIDLPGYRPVSTPHARQIEQAVKLIGEAKKPVLYVGGGVIKADAHEELRAFAEYTGIPVVTTLMALGTFPESHELHMGMPGMHGTVSAVGALQRSDLLIAIGSRFDDRVTGDVDTFAPDAKIIHADIDPAEIGKIKQVEVPIVGDAREVLARLLETTKASKAETEDISEWVDYLKGLKARFPRGYDEQPGDLLAPQFVIETLSKEVGPDAIYCAGVGQHQMWAAQFVDFEKPRTWLNSGGLGTMGYAVPAALGAKAGAPDKEVWAIDGDGCFQMTNQELTTAAVEGFPIKIALINNGNLGMVRQWQTLFYEGRYSNTKLRNQGEYMPDFVTLSEGLGCVAIRVTKAEEVLPAIQKAREINDRPVVIDFIVGEDAQVWPMVSAGSSNSDIQYALGLRPFFDGDESAAEDPADIHEAVSDIDAAVESTEA

SEQ ID NO: 6958 - protein, 172 aa, Corynebacterium glutamicum
MANSDVTRHILSVLVQDVDGIISRVSGMFTRRAFNLVSLVSAKTETHGINRITVVVDADELNIEQITKQLNKLIPVLKVVRLDEETTIARAIMLVKVSADSTNRPQIVDAANIFRARVVDVAPDSVVIESTGTPGKLRALLDVMEPFGIRELIQSGQIALNRGPKTMAPAKI

SEQ ID NO: 6959 - protein, 338 aa, Corynebacterium glutamicum
MAIELLYDADADLSLIQGRKVAIVGYGSQGHAHSQNLRDSGVEVVIGLREGSKSAEKAKEAGFEVKTTAEAAAWADVIMLLAPDTSQAEIFTNDIEPNLNAGDALLFGHGLNIHFDLIKPADDIIVGMVAPKGPGHLVRRQFVDGKGVPCLIAVDQDPTGTAQALTLSYAAAIGGARAGVIPTTFEAETVTDLFGEQAVLCGGTEELVKVGFEVLTEAGYEPEMAYFEVLHELKLIVDLMFEGGISNMNYSVSDTAEFGGYLSGPRVIDADTKSRMKDILTDIQDGTFTKRLIANVENGNTELEGLRASYNNHPIEETGAKLRDLMSWVKVDARAETA

SEQ ID NO: 6960 - protein, 340 aa, Corynebacterium glutamicum
MKLAVIGGDGIGPEVTAEALKVLNAVRDDIETTDYDLGARRYLKNGELLTDEDLASLREHDAILLGAIGAPGSVPPGILERGLLLKMRFALDHHVNLRPSKLYDGVESPLRNPGKIDFVVVREGTEGAYTGNGGAIRVGTPHEIANETSVNTRYGAERVIRYAFELAQSRRKKLTLVHKTNVLVHGGGLWQRTVDEVAKEYPEVAVDYNHIDAATIYLVTDPSRFDVIVTDNLFGDILTDEAGAVSGGIGLAASGNIDATGTNPSMFEPVHGSAPDIAGQGIADPTAAILSAAMLLRHLGDEDNAVRIETAIAADVAGRDNSQPISTTEVGDRIVKALQS

SEQ ID NO: 6961 - protein, 683 aa, Corynebacterium glutamicum
MASKLTTTSQHILENLGGPDNITSMTHCATRLRFQVKDQSIVDQQEIDSDPSVLGVVPQGSTGMQVVMGGSVANYYQEILKLDGMKHFADGEATESSSKKEYGGVRGKYSWIDYAFEFLSDTFRPILWALLGASLIITLLVLADTFGLQDFRAPMDEQPDTYVFLHSMWRSVFYFLPIMVGATAARKLGANEWIGAAIPAALLTPEFLALGSAGDTVTVFGLPMVLNDYSGQVFPPLIAAIGLYWVEKGLKKIIPEAVQMVFVPFFSLLIMIPATAFLLGPFGIGVGNGISNLLEAINNFSPFILSIVIPLLYPFLVPLGLHWPLNAIMIQNINTLGYDFIQGPMGAWNFACFGLVTGVFLLSIKERNKAMRQVSLGGMLAGLLGGISEPSLYGVLLRFKKTYFRLLPGCLAGGIVMGIFDIKAYAFVFTSLLTIPAMDPWLGYTIGIAVAFFVSMFLVLALDYRSNEERDEARAKVAADKQAEEDLKAEANATPAAPVAAAGAGAGAGAGAAAGAATAVAAKPKLAAGEVVDIVSPLEGKAIPLSEVPDPIFAAGKLGPGIAIQPTGNTVVAPADATVILVQKSGHAVALRLDSGVEILVHVGLDTVQLGGEGFTVHVERRQQVKAGDPLITFDADFIRSKDLPLITPVVVSNAAKFGEIEGIPADQANSSTTVIKVNGKNE

SEQ ID NO: 6962 - protein, 294 aa, Corynebacterium glutamicum
MQHFRDKIVVVKYGGNAMVDDDLKAAFAADMVFLRTVGAKPVVVHGGGPQISEMLNRVGLQGEFKGGFRVTTPEVMDIVRMVLFGQVGRDLVGLINSHGPYAVGTSGEDAGLFTAQKRMVNIDGVPTDIGLVGDIINVDASSLMDIIEAGRIPVVSTIAPGEDGQIYNINADTAAGALAAAIGAERLLVLTNVEGLYTDWPDKSSLVSKIKATELEAILPGLDSGMIPKMESCLNAVRGGVSAAHVIDGRIAHSVLLELLTMGGIGTMVLPDVFDRENYPEGTVFRKDDKDGEL

SEQ ID NO: 6963 - protein, 319 aa, Corynebacterium glutamicum
MTSQPQVRHFLADDDLTPAEQAEVLTLAAKLKAAPFSERPLEGPKSVAVLFDKTSTRTRFSFDAGIAHLGGHAIVVDSGSSQMGKGESLQDTAAVLSRYVEAIVWRTYAHSNFHAMAETSTVPLVNSLSDDLHPCQILADLQTIVENLSPEEGPAGLKGKKAVYLGDGDNNMANSYMIGFATAGMDISIIAPEGFQPRAEFVERAEKRGQETGAKVVVTDSLDEVAGADVVITDTWVSMGMENDGIDRTTPFVPYQVNDEVMAKANDGAIFLHCLPAYRGKEVAASVIDGPASKVFDEAENRLHAQKALLVWLLANQPR

SEQ ID NO: 6964 - protein, 171 aa, Corynebacterium glutamicum
MSLGSTPSTPENLNPVTRTARQALILQILDKQKVTSQVQLSELLLDEGIDITQATLSRDLDELGARKVRPDGGRAYYAVGPVDSIAREDLRGPSEKLRRMLDELLVSTDHSGNIAMLRTPPGAAQYLASFIDRVGLKEVVGTIAGDDTVFVLARDPLTGKELGELLSGRTT

SEQ ID NO: 6965 - protein, 467 aa, Corynebacterium glutamicum
MSVNPTRPEGGRHHVVVIGSGFGGLFAAKNLAKADVDVTLIDRTNHHLFQPLLYQVATGILSSGEIAPSTRQILGSQENVNVIKGEVTDINVESQTVTASLGEFTRVFEYDSLVVGAGAGQSYFGNDHFAEFAPGMKSIDDALEIRARIIGAFERAEICEDPAERERLLTFVVVGAGPTGVELAGQLAEMAHRTLAGEYKNFNTNSAKIILLDGAPQVLPPFGKRLGRNAQRTLEKMGVNVRLNAMVTNVDATSVTYKTKDGEEHTIESFCKIWSAGVAASPLGKLVAEQTGVETDRAGRVMVNDDLSVGDQKNVFVVGDMMNYNNLPGVAQVAIQSGEYVAEQIEAEVEGRSNTEREAFDYFDKGSMATISRFSAVVKMGKVEVTGFIGWVLWLAVHIMFLVGFRNRFVSAISWGLNALSRKRWNLATTRQQLHSRTTLSKFAHELEEASSDLPIELRDNQRFSGK

SEQ ID NO: 6966 - protein, 87 aa, Corynebacterium glutamicum
MKTFDSLYEELLNRAQTRPEGSGTVAALDKGIHHLGKKVIEEAGEVWIAAEYETDEELAGEISQLIYWTQVIMVARGLKPEDIYKNL

SEQ ID NO: 6967 - protein, 362 aa, Corynebacterium glutamicum
MIAAGVKDVAQCVDVMEETLVLLAQGDYKMAGLNSNSHGAMITFPENPEFEGMPKDGPDRRFMAMPAYLGGRFKNTGVKWYGSNAENKASGLPRSIHTFVLNDTVTGAPKAIMSANLLSAYRTGAVPGVGVKHLAVADATTLAVVGPGVMAKTITEACIAERPGITTIKIKGRSERGINAFATWALEKFPEIEVVAVGSEEDVVKDADIVIAATTTDAAGSSAFPYFKKEWLKPGALLLLPAAGRFDDAYLLDDARLVVDYMGLYEAWAEEYGPQAYQLLGIPGTHWYDLALQGKLDLAKISQIGDICSGKLPGRTNDEEIILYSVGGMPVEDVAWATQVYENALEKGVGTTLNLWESPALA

SEQ ID NO: 6968 - protein, 452 aa, Corynebacterium glutamicum
MDPSDLAWILAAFALVSLMFPGLSLLYGGMLGGQHVLNTFMMVMSSLGIISLVYIIYGHGLVLGNSIGGWGIIGNPLEYFGFRNIMEDDGTGDLMWAGFYILFAAISLALVSSGAAGRMRFGAWLVFGVLWFTFVYAPLAHWVFAIDDPESGYVGGWMKNVLEFHDFAGGTAVHMNAGASGLALAIVLGRRHSMAVRPHNLPLILIGAGLIVAGWFGFNGGTAGGANFLASYVVVTSLIAAAGGMMGFMLVERVFSGKPTFFGSATGTIAGLVAITPAADAVSPLGAFAVGALGAVVSFWAISWKKGHRVDDSFDVFAVHGMAGIAGALFVMLFGDPLAPAGVSGVFFGGELSLLWREPLAIIVTLTYAFGVTWLIATILNKFMTLRITSEAEYEGIDRAEHAESAYHLNSNGIGMATRTNFGPEIPEETVPDAVQVGVDKQKIADTRKASK

SEQ ID NO: 6969 - protein, 77 aa, Corynebacterium glutamicum
MALTLQIILVVASLLMTVFVLLHKGKGGGLSSLFGGGVQSNLSGSTVVEKNLDRVTILVAVIWIVCIVALNLIQTYS

SEQ ID NO: 6970 - protein, 919 aa, Corynebacterium glutamicum
MTDFLRDDIRFLGQILGEVIAEQEGQEVYELVEQARLTSFDIAKGNAEMDSLVQVFDGITPAKATPIARAFSHFALLANLAEDLYDEELREQALDAGDTPPDSTLDATWLKLNEGNVGAEAVADVLRNAEVAPVLTAHPTETRRRTVFDAQKWITTHMRERHALQSAEPTARTQSKLDEIEKNIRRRITILWQTALIRVARPRIEDEIEVGLRYYKLSLLEEIPRINRDVAVELRERFGEGVPLKPVVKPGSWIGGDHDGNPYVTAETVEYSTHRAAETVLKYYARQLHSLEHELSLSDRMNKVTPQLLALADAGHNDVPSRVDEPYRRAVHGVRGRILATTAELIGEDAVEGVWFKVFTPYASPEEFLNDALTIDHSLRESKDVLIADDRLSVLISAIESFGFNLYALDLRQNSESYEDVLTELFERAQVTANYRELSEAEKLEVLLKELRSPRPLIPHGSDEYSEVTDRELGIFRTASEAVKKFGPRMVPHCIISMASSVTDVLEPMVLLKEFGLIAANGDNPRGTVDVIPLFETIEDLQAGAGILDELWKIDLYRNYLLQRDNVQEVMLGYSDSNKDGGYFSANWALYDAELQLVELCRSAGVKLRLFHGRGGTVGRGGGPSYDAILAQPRGAVQGSVRITEQGEIISAKYGNPETARRNLEALVSATLEASLLDVSELTDHQRAYDIMSEISELSLKKYASLVHEDQGFIDYFTQSTPLQEIGSLNIGSRPSSRKQTSSVEDLRAIPWVLSWSQSRVMLPGWFGVGTALEQWIGEGEQATQRIAELQTLNESWPFFTSVLDNMAQVMSKAELRLAKLYADLIPDTEVAERVYSVIREEYFLTKKMFCVITGSDDLLDDNPLLARSVQRRYPYLLPLNVIQVEMMRRYRKGDQSEQVSRNIQLTMNGLSTALRNSG

SEQ ID NO: 6971 - protein, 410 aa, Corynebacterium glutamicum
MLGMLRWTTAGESHGQALIATVEHMPAGVPVTKDEVSYQLARRRLGYGRGARMKFEQDALTFLTGIRHGLTLGSPISIMIGNTEWDKWTTIMSSDALDMEDPDNVAAMSSGRGAKLTRPRPGHADYAGMLKYGFDDARNVLERSSARETAARVAAATVARSFLRETLGVEVLSHVISIGASEPYTGAEPTFADIQAIDDSPVRAFGKDAEESMIAEIEAAKKAGDTLGGIVEVIVEGLPIGLGSHISGEDRLDAQIAAALMGIQAIKGVEIGDGFEEARRRGSEAHDEVFLDDNGVYRNTNRAGGLEGGMTNGETLRVRAGMKPISTVPRALKTIDMENGKAATGIHQRSDVCAVPAAGVVAEAMVTLVLARAVLQKFGGDSLSETKSNIDTYLKNIEERMKFEGLEDGA

SEQ ID NO: 6972 - protein, 632 aa, Corynebacterium glutamicum
MSHHTHLNNYITSLSDNADLREKVTATVDAFRHTVMDDFDYISDQQVLLYGDVQSGKTSHMLGIIADCLDSTFHTIVILTSPNTRLVQQTYDRVAQAFPDTLVCDRDGYNDFRANQKSLTPRKSIVVVGKIPAVLGNWLRVFNDSGALSGHPVLIIDDEADATSLNTKVNQSDVSTINHQLTSIRDLATGCIYLQVTGTPQAVLLQSDDSNWAAEHVLHFAPGESYIGGQLFFSELNNPYLRLFANTQFDEDSRFSDAIYTYLLTAALFKLRGESLCTMLIHPSHTASSHRDFAQEARLQLTFAFERFYEPMIQHNFQRAYEQLAQTDSNLPPLRKILNILGGMEDDFSIHIVNSDNPTVEEDWADGYNIIVGGNSLGRGLTFNNLQTVFYVRESKRPQADTLWQHARMFGYKRHKDTMRVFMPATIAQTFQEVYLGNEAIKNQLDHGTHINDIRVILGDGVAPTRANVLDKRKVGNLSGGVNYFAADPRIKNVEALDKKLLAYLDKHGEDSTIGMRAIITILNAFTVDPNDLDLATFKAALLDFERNQPHLTARMVLRTNRKVNQGTGALLSPTDQALSRAEVAHPLLILYRIEGVNDAAAQRGEPTWSSDPIWVPNIKLPGQRQFWCVDG

SEQ ID NO: 6973 - protein, 331 aa, Corynebacterium glutamicum
MTAPSTQDLATTEREVDPGSRRGQTNDNPSQDLVRVYLNGIGKTALLTAEDEVELAQTIEVGLYAEHLLKNSEEPLTRAMKRDLKVLAKDGKKARSHLLEANLRLVVSLAKRYTGRGMPLLDLIQEGNLGLIRAMEKFDYSKGFKFSTYATWWIRQAITRGMADQSRTIRLPVHLVEQVNKLSRIKRELYQHLGREATNEELAEESGIEESKIEMLLRQSRDPVSLDMPVGADEEAPLGDFIEDSEATDAESAVVASMRHSDIRAVLNTLEPREQDVIRLRYGLDDGVPRTLDQIGRRFGLSRERVRQIEREVMSKLRDGERASRLREYAQ

SEQ ID NO: 6974 - protein, 295 aa, Corynebacterium glutamicum
MSAKRTFTRIGAILGATALAGVTLTACGDSSGGDGFLAAIENGSVNVGTKYDQPGLGLRNPDNSMSGLDVDVAEYVVNSIADDKGWDHPTIEWRESPSAQRETLIQNGEVDMIAATYSINAGRSESVNFGGPYLLTHQALLVRQDDDRIETLEDLDNGLILCSVSGSTPAQKVKDVLPGVQLQEYDTYSSCVEALSQGNVDALTTDATILFGYSQQYEGDFRVVEMEKDGEPFTDEYYGIGLKKDDQEGTDAINAALERMYADGTFQRLLTENLGEDSVVVEEGTPGDLSFLDAS

SEQ ID NO: 6975 - protein, 376 aa, Corynebacterium glutamicum
MAPKKTATKATAAKGNDRQKALDAALALIEKDFGKGAVMRLGDENRPPIQTISSGNTAIDIALGIGGFPRGRIVEVYGPESSGKTTVALHAIAQAQKAGGIAAFIDAEHALDPDYARKLGVDTDALLVSQPDTGEQALEIADMLVRSGAIDIIVIDSVAALTPKAEIEGEMGDSHVGLQARLMSQALRKMTGALYNSGTTAIFINQLREKIGVMFGSPETTTGGKALKFYASVRCDIRRIQTLKDGQDAIGNRTRLKVVKNKVSPPFKIAEFDIMYGEGISRESSVIDLAVDNGIVKKSGSWFTYEGEQLGQGKEKVRLSLKENPELTDELEDKIFKKLGVGKYAAASDELTDDPVELVPNVDFDDEADTEADAED

SEQ ID NO: 6976 - protein, 301 aa, Corynebacterium glutamicum
MSTGLTAKTGVEHFGTVGVAMVTPFTESGDIDIAAGREVAAYLVDKGLDSLVLAGTTGESPTTTAAEKLELLKAVREEVGDRAKLIAGVGTNNTRTSVELAEAAASAGADGLLVVTPYYSKPSQEGLLAHFGAIAAATEVPICLYDIPGRSGIPIESDTMRRLSELPTILAVKDAKGDLVAATSLIKETGLAWYSGDDPLNLVWLALGGSGFISVIGHAAPTALRELYTSFEEGDLVRAREINAKLSPLVAAQGRLGGVSLAKAALRLQGINVGDPRLPIMAPNEQELEALREDMKKAGVL

SEQ ID NO: 6977 - protein, 248 aa, Corynebacterium glutamicum
MGIKVGVLGAKGRVGQTIVAAVNESDDLELVAEIGVDDDLSLLVDNGAEVVVDFTTPNAVMGNLEFCINNGISAVVGTTGFDDARLEQVRDWLEGKDNVGVLIAPNFAISAVLTMVFSKQAARFFESAEVIELHHPNKLDAPSGTAIHTAQGIAAARKEAGMDAQPDATEQALEGSRGASVDGIPVHAVRMSGMVAHEQVIFGTQGQTLTIKQDSYDRNSFAPGVLVGVRNIAQHPGLVVGLEHYLGL

SEQ ID NO: 6978 - protein, 500 aa, Corynebacterium glutamicum
MSDSPKNAPRITDEADVVLIGAGIMSSTLGAMLRQLEPSWTQIVFERLDGPAQESSSPWNNAGTGHSALCELNYTPEVKGKVEIAKAVGINEKFQVSRQFWSHLVEEGVLSDPKEFINPVPHVSFGQGADQVAYIKARYEALKDHPLFQGMTYADDEATFTEKLPLMAKGRDFSDPVAISWIDEGTDINYGAQTKQYLDAAEVEGTEIRYGHEVKSIKADGAKWIVTVKNVHTGDTKTIKANFVFVGAGGYALDLLRSAGIPQVKGFAGFPVSGLWLRCTNEELIEQHAAKVYGKASVGAPPMSVPHLDTRVIEGEKGLLFGPYGGWTPKFLKEGSYLDLFKSIRPDNIPSYLGVAAQEFDLTKYLVTEVLKDQDKRMDALREYMPEAQNGDWETIVAGQRVQVIKPAGFPKFGSLEFGTTLINNSEGTIAGLLGASPGASIAPSAMIELLERCFGDRMIEWGDKLKDMIPSYGKKLASEPALFEQQWARTQKTLKLEEA

SEQ ID NO: 6979 - protein, 692 aa, Corynebacterium glutamicum
MNNPAQLRQDTEKEVLALLGSLVLPAGTALAATGSLARSELTPYSDLDLILIHPPGATPDGVEDLWYPIWDAKKRLDYSVRTPDECVAMISADSTAALAMLDLRFVAGDEDLCAKTRRRIVEKWRQELNKNFDAVVDTAIARWRRSGPVVAMTRPDLKHGRGGLRDFELIKALALGHLCNLPQLDAQHQLLLDARTLLHVHARRSRDVLDPEFAVDVAMDLGFVDRYHLGREIADAARAIDDGLTTALATARGILPRRTGFAFRNASRRPLDLDVVDANGTIELSKKPDLNDPALPLRVAAAAATTGLPVAESTWVRLNECPPLPEPWPANAAGDFFRILSSPKNSRRVVKNMDRHGLWSRFVPEWDRIKGLMPREPSHISTIDEHSLNTVAGCALETVTVARPDLLVLGALYHDIGKGFPRPHEQVGAEMVARAASRMGLNLRDRASVQTLVAEHTAVAKIAARLDPSSEGAVDKLLDAVRYDLVTLNLLEVLTEADAKATGPGVWTARLEHALRIVCKRARDRLTDIRPVAPMIAPRSEIGLVERDGVFTVQWHGEDLHRILGVIYAKGWTITAARMLANGQWSAEFDVRANGPQDFDPQHFLQAYQSGVFSEVPIPALGITATFWHGNTLEVRTELRTGAIFALLRTLPDALWINAVTRGATLIIQAALKPGFDRATVERSVVRSLAGS

SEQ ID NO: 6980 - protein, 112 aa, Corynebacterium glutamicum
MKLITAIVKPFTLTDIKDALEQAGVQGMTVTETQGFGQQKGHTEVYRGAEYAVDFVPKVKIEVIISDAQAEEVINIIVETARTGKVGDGKVWMTNIEELVRVRTGERGEAAL

SEQ ID NO: 6981 - protein, 438 aa, Corynebacterium glutamicum
MGADQIAAVSGNSAWMLMSASLVLLMTPALALFYGGMSRQKSVLNMMMMSFGALGVVTVIYLLWGWSMSYGTQSIAGIFANPFEFFGLKDSIVDADGNYIEGAAGYPNIIDIGFQLTFAVISTALISGALAERVKFSTWLIFSGAWVTLVYFPLAHMVWGGGLLGHNVTGFASWLFGSTDGEANIAPIDFAGGTVVHISAGTAALVLAFIVGKRKTFGKAIARPHNLPMVMLGAALLWFGWFGFNGGSAFAADGLAGLAWVNTTAATAAAMLGWLATEKFRDGHATSLGAASGVVAGLVAITPAAGALTPVTSLILGAIGGILACLGVGLKYRFGFDDSLDVVGVHLVAGLWGTVGVGLLATDIGWFSGGGMDGLKLFIVQIVIALVAVVFAGVITALIAFALKATVGWRVDDDVEQQGIDTHEHAESAYDTTGPEIR

SEQ ID NO: 6982 - protein, 447 aa, Corynebacterium glutamicum
MTVDEQVSNYYDMLLKRNAGEPEFHQAVAEVLESLKIVLEKDPHYADYGLIQRLCEPERQLIFRVPWVDDQGQVHVNRGFRVQFNSALGPYKGGLRFHPSVNLGIVKFLGFEQIFKNSLTGLPIGGGKGGSDFDPKGKSDLEIMRFCQSFMTELHRHIGEYRDVPAGDIGVGGREIGYLFGHYRRMANQHESGVLTGKGLTWGGSLVRTEATGYGCVYFVSEMIKAKGESISGQKIIVSGSGNVATYAIEKAQELGATVIGFSDSSGWVHTPNGVDVAKLREIKEVRRARVSVYADEVEGATYHTDGSIWDLKCDIALPCATQNELNGENAKTLADNGCRFVAEGANMPSTPEAVEVFRERDIRFGPGKAANAGGVATSALEMQQNASRDSWSFEYTDERLQVIMKNIFKTCAETAAEYGHENDYVVGANIAGFKKVADAMLAQGVI

SEQ ID NO: 6983 - protein, 475 aa, Corynebacterium glutamicum
MDRRTKIVCTLGPAVASADGILRLVEDGMDVARLNFSHGDHPDHEQNYKWVREAAEKTGRAVGILADLQGPKIRLGRFTDGATVWENGETIRITVDDVEGTHDRVSTTYKNLAKDAKPGDRLLVDDGKVGLVCVSVEGNDVICEVVEGGPVSNNKGVSLPGMDISVPALSEKDIRDLRFALKLGVDFIALSFVRSPADAELVHKIMDEEGRRVPVIAKLEKPEAVTSLEPIVLAFDAVMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRVARLHSHLPLLVFTPNEAVRSELALTWGATTFLCPPVSDTDDMMREVDRALLAMPEYNKGDMMVVVAGSPPGVTGNTNMIHVHLLGDDTRIAKL

SEQ ID NO: 6984 - protein, 323 aa, Corynebacterium glutamicum
MPQKPASFAVGFDIGGTNMRAGLVDESGRIVTSLSAPSPRTTQAMEQGIFDLVEQLKAEYPVGAVGLAVAGFLDPECEVVRFAPHLPWRDEPVREKLENLLGLPVRLEHDANSAAWGEHRFGAAQGADNWVLLALGTGIGAALIEKGEIYRGAYGTAPEFGHLRVVRGGRACACGKEGCLERYCSGTALVYTARELASHGSFRNSGLFDKIKADPNSINGKTITAAARQEDPLALAVLEDFSEWLGETLAIIADVLDPGMIIIGGGLSNAADLYLDRSVNHYSTRIVGAGYRPLARVATAQLGADAGMIGVADLARRSVVEAN

SEQ ID NO: 6985 - protein, 477 aa, Corynebacterium glutamicum
MAFETPEEIVKFIKDENVEFVDVRFTDLPGTEQHFSIPAASFDADTIEEGLAFDGSSIRGFTTIDESDMNLLPDLGTATLDPFRKAKTLNVKFFVHDPFTREAFSRDPRNVARKAEQYLASTGIADTCNFGAEAEFYLFDSVRYSTEMNSGFYEVDTEEGWWNRGKETNLDGTPNLGAKNRVKGGYFPVAPYDQTVDVRDDMVRNLAASGFALERFHHEVGGGQQEINYRFNTMLHAADDIQTFKYIIKNTARLHGKAATFMPKPLAGDNGSGMHAHQSLWKDGKPLFHDESGYAGLSDIARYYIGGILHHAGAVLAFTNATLNSYHRLVPGFEAPINLVYSQRNRSAAVRIPITGSNPKAKRIEFRAPDPSGNPYLGFAAMMMAGLDGIKNRIEPHAPVDKDLYELPPEEAASIPQAPTSLEASLKALQEDTDFLTESDVFTEDLIEAYIQYKYDNEISPVRLRPTPQEFELYFDC

SEQ ID NO: 6986 - protein, 481 aa, Corynebacterium glutamicum
MDYISTRDASRTPARFSDILLGGLAPDGGLYLPATYPQLDDAQLSKWREVLANEGYAALAAEVISLFVDDIPVEDIKAITARAYTYPKFNSEDIVPVTELEDNIYLGHLSEGPTAAFKDMAMQLLGELFEYELRRRNETINILGATSGDTGSSAEYAMRGREGIRVFMLTPAGRMTPFQQAQMFGLDDPNIFNIALDGVFDDCQDVVKAVSADAEFKKDNRIGAVNSINWARLMAQVVYYVSSWIRTTTSNDQKVSFSVPTGNFGDICAGHIARQMGLPIDRLIVATNENDVLDEFFRTGDYRVRSSADTHETSSPSMDISRASNFERFIFDLLGRDATRVNDLFGTQVRQGGFSLADDANFEKAAAEYGFASGRSTHADRVATIADVHSRLDVLIDPHTADGVHVARQWRDEVNTPIIVLETALPVKFADTIVEAIGEAPQTPERFAAIMDAPFKVSDLPNDTDAVKQYIVDAIANTSVK

SEQ ID NO: 6987 - protein, 615 aa, Corynebacterium glutamicum
MSSNIAITTEPEGKNKKGLKSDPFIFSISVGFIVVFVIATIALGEKARTTFSAIAGWLLENLGWMYIGGVSLVFIFLMGIFASRYGRVKLGDDDDDPEHTLIVWFCMLFAGGVGAVLMFWGVAEPINHAFNVPMANEESMSEAAIVQAFAYTFYHFGIHMWVIMALPGLSLGYFIYKRKLPPRLSSVFSPILGKHIYSTPGKLIDVLAIVGTTFGIAVSVGLGVLQINAGMNKLWSTPQVSWVQLLIILIITAVACISVASGLDKGIKLLSNINIAMAVALMFFILFTGPTLTLLRFLVESFGIYASWMPNLMFWTDSFQDNPGWQGKWTVFYWAWTICWSPYVGMFVARISRGRTVREFIGGVLALPAIFGVVWFSIFGRAGIEVELSNPGFLTQPTVVEGDVPAALFNVLQEYPLTGIVSAFALVIIVIFFITSIDSAALVNDMFATGAENQTPTSYRVMWACTIGAVAGSLLIISPSSGIATLQEVVIIVAFPFFLVQFVMMFSLLKGMSEDAAAVRRVQTRQWEKTDTPEKLEEHSSQPAPGYDDEGNPLPMPALEHDEDGNIVIPGNVVIEGDLGVVGDVVDDPEEAQEMGSRFKIVEQTRPQSRDEYDI

SEQ ID NO: 6988 - protein, 739 aa, Corynebacterium glutamicum
MTEQELLSAQTADNAGTDSTERVDAGGMQVAKVLYDFVTEAVLPRVGVDAEKFWSGFAAIARDLTPRNRELLARRDELQMLIDDYHRNNSGTIDQEAYEDFLKEIGYLVEEPEAAEIRTQNVDTEISSTAGPQLVVPILNARFALNAANARWGSLYDALYGTNAIPETDGAEKGKEYNPVRGQKVIEWGREFLDSVVPLDGASHADVEKYNITDGKLAAHIGDSVYRLKNRESYRGFTGNFLDPEAILLETNGLHIELQIDPVHPIGKADKTGLKDIVLESAITTIMDFEDSVAAVDAEDKTLGYSNWFGLNTGELKEEMSKNGRIFTRELNKDRVYIGRNGTELVLHGRSLLFVRNVGHLMQNPSILIDGEEIFEGIMDAVLTTVCAIPGIAPQNKMRNSRKGSIYIVKPKQHGPEEVAFTNELFGRVEDLLDLPRHTLKVGVMDEERRTSVNLDASIMEVADRLAFINTGFLDRTGDEIHTSMEAGAMVRKADMQTAPWKQAYENNNVDAGIQRGLPGKAQIGKGMWAMTELMAEMLEKKIGQPREGANTAWVPSPTGATLHATHYHLVDVFKVQDELRAAGRRDSLRNILTIPTAPNTNWSEEEKKEEMDNNCQSILGYVVRWVEHGVGCSKVPDIHDIDLMEDRATLRISSQMLANWIRHDVVSKEQVLESLERMAVVVDKQNAGDEAYRDMAPNYDASLAFQAAKDLIFEGTKSPSGYTEPILHARRREFKAKN

SEQ ID NO: 6989 - protein, 432 aa, Corynebacterium glutamicum
MSNVGKPRTAQEIQQDWDTNPRWNGITRDYTADQVADLQGSVIEEHTLARRGSEILWDAVTQEGDGYINALGALTGNQAVQQVRAGLKAVYLSGWQVAGDANLSGHTYPDQSLYPANSVPSVVRRINNALLRSDEIARTEGDTSVDNWVVPIVADGEAGFGGALNVYELQKAMIAAGAAGTHWEDQLASEKKCGHLGGKVLIPTQQHIRTLNSARLAADVANTPTVVIARTDAEAATLITSDVDERDQPFITGERTAEGYYHVKNGLEPCIARAKSYAPYADMIWMETGTPDLELAKKFAEGVRSEFPDQLLSYNCSPSFNWSAHLEADEIAKFQKELGAMGFKFQFITLAGFHSLNYGMFDLAYGYAREGMTSFVDLQNREFKAAEERGFTAVKHQREVGAGYFDQIATTVDPNSSTTALKGSTEEGQFHN

SEQ ID NO: 6990 - protein, 369 aa, Corynebacterium glutamicum
MRERISNAKRVVVKIGSSSLTNDEDGHTVDPNRINTIVNALQARMEAGSDLIVVSSGAVAAGMAPLGLSTRPTELAVKQAAAAVGQVHLMHQWGRSFARYGRPIGQVLLTAADAGKRDRARNAQRTIDKLRILGAVPIVNENDTVATTGVNFGDNDRLAAIVAHLVSADALVLLSDVDGLFDKNPTDPTAKFISEVRDGNDLKGVIAGDGGKVGTGGMASKVSAARLASRSGVPVLLTSAANIGPALEDAQVGTVFHPKDNRLSAWKFWALYAADTAGKIRLDDGAVEAVTSGGKSLLAVGITEIIGDFQQGEIVEILGPAGQIIGRGEVSYDSDTLQSMVGMQTQDLPDGMQRPVVHADYLSNYASRA

SEQ ID NO: 6991 - protein, 386 aa, Corynebacterium glutamicum
MSFDPNTQGFSTASIHAGYEPDDYYGSINTPIYASTTFAQNAPNELRKGYEYTRVGNPTIVALEQTVAALEGAKYGRAFSSGMAATDILFRIILKPGDHIVLGNDAYGGTYRLIDTVFTAWGVEYTVVDTSVVEEVKAAIKDNTKLIWVETPTNPALGITDIEAVAKLTEGTNAKLVVDNTFASPYLQQPLKLGAHAVLHSTTKYIGGHSDVVGGLVVTNDQEMDEELLFMQGGIGPIPSVFDAYLTARGLKTLAVRMDRHCDNAEKIAEFLDSRPEVSTVLYPGLKNHPGHEVAAKQMKRFGGMISVRFAGGEEAAKKFCTSTKLICLAESLGGVESLLEHPATMTHQSAAGSQLEVPRDLVRISIGIEDIEDLLADVEQALNNL

SEQ ID NO: 6992 - protein, 148 aa, Corynebacterium glutamicum
MLIVYFSSATDNTHRFVQKLDLPNVRIPLTRVEEPLKINEPYVLITPTYGGGVSMTGENSRPVPPQVIRFLNDEHNRSFIRAVVAGGNSNFGSDFGLAGEIISKKCKVPYVYRFELMGNEEDVSILRGGLTQNAQALGLEPQEPVTSR

SEQ ID NO: 6993 - protein, 77 aa, Corynebacterium glutamicum
MAITVYTKPACVQCNATKKALDRAGLEYDLVDISLDEEAREYVLALGYLQAPVVVADGSHWSGFRPERIREMATAAA

SEQ ID NO: 6994 - protein, 320 aa, Corynebacterium glutamicum
MTNIRVAIVGYGNLGRSVEKLIAKQPDMDLVGIFSRRATLDTKTPVFDVADVDKHADDVDVLFLCMGSATDIPEQAPKFAQFACTVDTYDNHRDIPRHRQVMNEAATAAGNVALVSTGWDPGMFSINRVYAAAVLAEHQQHTFWGPGLSQGHSDALRRIPGVQKAVQYTLPSEDALEKARRGEAGDLTGKQTHKRQCFVVADAADHERIENDIRTMPDYFVGYEVEVNFIDEATFDSEHTGMPHGGHVITTGDTGGFNHTVEYILKLDRNPDFTASSQIAFGRAAHRMKQQGQSGAFTVLEVAPYLLSPENLDDLIARDV

SEQ ID NO: 6995 - protein, 45 aa, Corynebacterium glutamicum
MENVYEFLGNLDVLSGSGLIGYVFDFLGASSKWAGAVADLIGLLG

SEQ ID NO: 6996 - protein, 397 aa, Corynebacterium glutamicum
MALALVLNSGSSSIKFQLVNPENSAIDEPYVSGLVEQIGEPNGRIVLKIEGEKYTLETPIADHSEGLNLAFDLMDQHNCGPSQLEITAVGHRVVHGGILFSAPELITDEIVEMIRDLIPLAPLHNPANVDGIDVARKILPDVPHVAVFDTGFFHSLPPAAALYAINKDVAAEHGIRRYGFHGTSHEFVSKRVVEILEKPTEDINTITFHLGNGASMAAVQGGRAVDTSMGMTPLAGLVMGTRSGDIDPGIVFHLSRTAGMSIDEIDNLLNKKSGVKGLSGVNDFRELREMIDNNDQDAWSAYNIYIHQLRRYLGSYMVALGRVDTIVFTAGVGENAQFVREDALAGLEMYGIEIDPERNALPNDGPRLISTDASKVKVFVIPTNEELAIARYAVKFA

SEQ ID NO: 6997 - protein, 329 aa, Corynebacterium glutamicum
MSAELFENWLLKRARAEHSHIVLPEGDDDRILMAAHQLLDQDICDITILGDPVKIKERATELGLHLNTAYLVNPLTDPRLEEFAEQFAELRKSKSVTIDEAREIMKDISYFGTMMVHNGDADGMVSGAANTTAHTIKPSFQIIKTVPEASVVSSIFLMVLRGRLWAFGDCAVNPNPTAEQLGEIAVVSAKTAAQFGIDPRVAILSYSTGNSGGGSDVDRAIDALAEARRLNPELCVDGPLQFDAAVDPGVARKKMPDSDVAGQANVFIFPDLEAGNIGYKTAQRTGHALAVGPILQGLNKPVNDLSRGATVPDIVNTVAITAIQAGGRS

SEQ ID NO: 6998 - protein, 459 aa, Corynebacterium glutamicum
MSTFHKVLINTMISNVTTGFLFFAVVFWMYLSTGNVALTGIVSGIYMGLIAVCSIFFGTVVDHNRKKSVMLFSSVTTLVFYCLSALVWVFWLEEDGLSIGNTALWVFVSFILIGSIVEHMRNIALSTVVTLLVPEAERDKANGLVGAVQGVGFLVTSVIAGSAIGFLGMEITLWICLGLSLVALLHLLPIRVDEPEIITQEDAQPTVSDDSVPTPTSDLAIVSKGIDLKGSMKIILSVPGLLALVLFASFNNLIGGVYSALMDPYGLELFSPQLWGLLLGLTSLGFIVGGAVISKTGLGKNPVRTLLLVNVGVAFVGMLFAIREWWWLYILGIFIFMAITPAAEAAEQTILQRVVPFRQQGRVFGLAMAVEMAANPLSTVIVAILAEAYLIPWMAGPGADTIWGVILGEGKARGMALMFLASGAIMLVVVLLAFMSRSYRKLSQYYATTSQDIAGAAEK

SEQ ID NO: 6999 - protein, 852 aa, Corynebacterium glutamicum
MSSFNPTTKTNEAMQAALQQASSAGNPDIRPAHLLAAILEQTDGVAAPVLMATGVDPKEILAEAKKLVASYPKASGANMANPNFNRDALNAFTAAQELAGELGDEYVSTEVLLAGIARGKSDAADLLTNKGATYDAIKEAFPSVRGSQRVTTQDPEGQFQALEKYSTDLTKLAREGKIDPVIGRDQEIRRVVQVLSRRTKNNPVLIGEPGVGKTAIVEGLARRIVAGDVPESLKGKTLISLDLGSMVAGAKYRGEFEERLKAVLDEIKGANGEVVTFIDELHTIVGAGASGESAMDAGNMIKPLLARGELRLVGATTLNEYRKYIEKDAALERRFQQVYVGEPTVEDAIGILRGLKERYEVHHGVRIQDSALVAAAELSNRYITSRFLPDKAIDLVDEAASRLRMEIDSSPQEIDELERIVRRLEIEEMALSKESDAASKERLEKLRSELADEREKLSELKARWQNEKTAIDDVREMKEELEALRSESDIAERDGNYGRVAELRYGRIPELEKQIEDAESKVEVNENAMLTEEVTPDTIADVVSAWTGIPAGKMMQGETEKLLNMERVLGNRVVGQLEAVTAVSDAVRRSRAGVADPNRPTGSFLFLGPTGVGKTELAKAVAEFLFDDDRAMIRIDMSEYGEKHSVARLVGAPPGYVGYDQGGQLTEAVRRRPYTVVLFDEVEKAHPDVFDILLQVLDEGRLTDGQGRTVDFRNTILILTSNLGAGGTREQMMDAVKMAFKPEFVNRLDDVVIFDRLSPEQLTSIVDIQIKQLTDRLAGRRLNLRVSDSAKAWLAERGYDPAYGARPLRRLIQQAIGDTLAKELLAGNVRDGDGVLVDVADGGQKLDVSRAV

SEQ ID NO: 7000 - protein, 315 aa, Corynebacterium glutamicum
MSDAPTVVAYLGPAGTFTEEALYKFADAGVFGDGEIEQLPAKSPQEAVDAVRHGTAQFAVVAIENFVDGPVTPTFDALDQGSNVQIIAEEELDIAFSIMVRPGTSLADVKTLATHPVGYQQVKNWMATTIPDAMYLSASSNGAGAQMVAEGTADAAAAPSRAAELFGLERLVDDVADVRGARTRFVAVQAQAAVSEPTGHDRTSVIFSLPNVPGSLVRALNEFAIRGVDLTRIESRPTRKVFGTYRFHLDISGHIRDIPVAEALRALHLQAEELVFVGSWPSNRAEDSTPQTDQLAKLHKADEWVRAASEGRKLN

SEQ ID NO: 7001 - protein, 504 aa, Corynebacterium glutamicum
MSPIRSKKKIKNEPRLTVDDVNVVPPKKIRPAIKGTVVGNFMEWYDFGIYGYLTVTMTAVFTQGLPQEWQLLAVMFGFAVSYLVRPLGGLVLGPLGDKVGRQKVLYVTMAMMAVSTALIGLLPTAASIGAWALVLLYLLKMVQGFSTGGEYAGATTYVAEFAPDRRRGFFGAFLDMGSYLGFAAGASVVAITTWVTTHFYGATAMEDFGWRIPFLTAIPLGIIAVYLRTRIPETPAFENNQDEPNAVVEKDTEDPYARLGLAGVIRHHWRPLLIGIAIVAATNTAGYALTSYMPVYLEEQIGLHSASAAAVTVPILVVMSLLLPFVGMWSDRVGRKPVYATAVAATLILMVPAFLIMNTGTIGAVLIALSMVAIPTGLYVALSASALPALFPTASRFSGMGISYNISVSLFGGTTPLITQFLLQKTGLDIVPALYIMFFSAIAGVALLFMTESSQKPLLGSFPTVETKSEAVEIVKNQDEDPNIDLSHMPFPDEENVGAEKQNA

SEQ ID NO: 7002 - DNA, 30 bp, Artificial Sequence
  Description of Artificial Sequence:synthetic DNA
ccgggttgatattagatttcataaatatac

SEQ ID NO: 7003 - DNA, 30 bp, Artificial Sequence
  Description of Artificial Sequence:synthetic DNA
gccaaacctaaagtgtcaaagcccaggtcc

SEQ ID NO: 7004 - DNA, 22 bp, Artificial Sequence
  Description of Artificial Sequence:synthetic DNA
tggggcggggttagatcctggg

SEQ ID NO: 7005 - DNA, 25 bp, Artificial Sequence
  Description of Artificial Sequence:synthetic DNA
ctttttacagaaaggtttaggaaac

SEQ ID NO: 7006 - DNA, 26 bp, Artificial Sequence
  Description of Artificial Sequence:synthetic DNA
tcgcgaagtagcacctgtcacttttg

SEQ ID NO: 7007 - DNA, 34 bp, Artificial Sequence
  Description of Artificial Sequence:synthetic DNA
ggccggttgcaccaacaactgcgatggtggtcat

SEQ ID NO: 7008 - DNA, 29 bp, Artificial Sequence
  Description of Artificial Sequence:synthetic DNA
gatccgatgaggctttggctctgcgtggc

SEQ ID NO: 7009 - DNA, 29 bp, Artificial Sequence
  Description of Artificial Sequence:synthetic DNA
cttcattggtggactcggtaactgcagcg

SEQ ID NO: 7010 - DNA, 25 bp, Artificial Sequence
  Description of Artificial Sequence:synthetic DNA
agtggcaacattgagcgggtgacta

SEQ ID NO: 7011 - DNA, 27 bp, Artificial Sequence
  Description of Artificial Sequence:synthetic DNA
cgctcaattgcgttttccaactgggat

SEQ ID NO: 7012 - DNA, 24 bp, Artificial Sequence
  Description of Artificial Sequence:synthetic DNA
tcaacggtgctgcggatctggcgt

SEQ ID NO: 7013 - DNA, 24 bp, Artificial Sequence
  Description of Artificial Sequence:synthetic DNA
aatgtctcctaacgatgcattcat

SEQ ID NO: 7014 - DNA, 25 bp, Artificial Sequence
  Description of Artificial Sequence:synthetic DNA
gtggccctggtcgtacagaaatatg

SEQ ID NO: 7015 - DNA, 25 bp, Artificial Sequence
  Description of Artificial Sequence:synthetic DNA
ctttagcgtccggtgcctgcataaa

SEQ ID NO: 7016 - DNA, 25 bp, Artificial Sequence
  Description of Artificial Sequence:synthetic DNA
atgaccaccatcgcagttgttggtg

SEQ ID NO: 7017 - DNA, 26 bp, Artificial Sequence
  Description of Artificial Sequence:synthetic DNA
tacttaaccagcagctcagcgatctg

SEQ ID NO: 7018 - DNA, 26 bp, Artificial Sequence
  Description of Artificial Sequence:synthetic DNA
atggctaagatcatctggacccgcac

SEQ ID NO: 7019 - DNA, 27 bp, Artificial Sequence
  Description of Artificial Sequence:synthetic DNA
ttacttcttcagtgcgtcaacgatctc

SEQ ID NO: 7020 - DNA, 24 bp, Artificial Sequence
  Description of Artificial Sequence:synthetic DNA
gtgtcgactcacacatcttcaacg

SEQ ID NO: 7021 - DNA, 25 bp, Artificial Sequence
  Description of Artificial Sequence:synthetic DNA
ttaggaaacgacgacgatcaagtcg

SEQ ID NO: 7022 - DNA, 25 bp, Artificial Sequence
  Description of Artificial Sequence:synthetic DNA
gtgaatactcaatcagattctgcgg

SEQ ID NO: 7023 - DNA, 25 bp, Artificial Sequence
  Description of Artificial Sequence:synthetic DNA
agcgatagtgatccgttgaccaaac

SEQ ID NO: 7024 - DNA, 25 bp, Artificial Sequence
  Description of Artificial Sequence:synthetic DNA
atgacctctcgcaccccgcttgttt

SEQ ID NO: 7025 - DNA, 26 bp, Artificial Sequence
  Description of Artificial Sequence:synthetic DNA
agaggtacagacccgcttcagaatta

SEQ ID NO: 7026 - DNA, 25 bp, Artificial Sequence
  Description of Artificial Sequence:synthetic DNA
tcacaccatcaacctagacggcatt

SEQ ID NO: 7027 - DNA, 25 bp, Artificial Sequence
  Description of Artificial Sequence:synthetic DNA
gttggagtgcaaagctgtgttgagt

SEQ ID NO: 7028 - DNA, 25 bp, Artificial Sequence
  Description of Artificial Sequence:synthetic DNA
gtgaactctgaactcaaaccaggat

SEQ ID NO: 7029 - DNA, 27 bp, Artificial Sequence
  Description of Artificial Sequence:synthetic DNA
actcgctcaggtactgcttcaaaattg

SEQ ID NO: 7030 - DNA, 25 bp, Artificial Sequence
  Description of Artificial Sequence:synthetic DNA
atggctacagttgaaaatttcaatg

SEQ ID NO: 7031 - DNA, 25 bp, Artificial Sequence
  Description of Artificial Sequence:synthetic DNA
agtgagaggatgtcgtcgagcgttt

SEQ ID NO: 7032 - DNA, 26 bp, Artificial Sequence
  Description of Artificial Sequence:synthetic DNA
atgacctcagcatctgccccaagctt

SEQ ID NO: 7033 - DNA, 24 bp, Artificial Sequence
  Description of Artificial Sequence:synthetic DNA
gtccctttcgaggcggatcacact

SEQ ID NO: 7034 - DNA, 27 bp, Artificial Sequence
  Description of Artificial Sequence:synthetic DNA
atggtgatcatggaaatcttcattaca

SEQ ID NO: 7035 - DNA, 26 bp, Artificial Sequence
  Description of Artificial Sequence:synthetic DNA
acccatcaacatcagtttgatggcca

SEQ ID NO: 7036 - DNA, 18 bp, Artificial Sequence
  Description of Artificial Sequence:synthetic DNA
atggtgatcttcggtgtc

SEQ ID NO: 7037 - DNA, 21 bp, Artificial Sequence
  Description of Artificial Sequence:synthetic DNA
ttatggcctgcgccaggtgtg

SEQ ID NO: 7038 - DNA, 27 bp, Artificial Sequence
  Description of Artificial Sequence:synthetic DNA
atgactgattttttacgcgatgacatc

SEQ ID NO: 7039 - DNA, 26 bp, Artificial Sequence
  Description of Artificial Sequence:synthetic DNA
gaaagaccgttcatggtcagctgaat

SEQ ID NO: 7040 - DNA, 25 bp, Artificial Sequence
  Description of Artificial Sequence:synthetic DNA
gtgaatttgaccatcccctttgcca

SEQ ID NO: 7041 - DNA, 26 bp, Artificial Sequence
  Description of Artificial Sequence:synthetic DNA
ccaatccagcatcagctaaagcagca

SEQ ID NO: 7042 - DNA, 26 bp, Artificial Sequence
  Description of Artificial Sequence:synthetic DNA
tgagcacaggtttaacagctaagacc

SEQ ID NO: 7043 - DNA, 25 bp, Artificial Sequence
  Description of Artificial Sequence:synthetic DNA
ggagagcctcaagttcctgctcatt

SEQ ID NO: 7044 - DNA, 25 bp, Artificial Sequence
  Description of Artificial Sequence:synthetic DNA
atgggaatcaaggttggcgttctcg

SEQ ID NO: 7045 - DNA, 25 bp, Artificial Sequence
  Description of Artificial Sequence:synthetic DNA
caggcctaggtaatgctcaagtcct

SEQ ID NO: 7046 - DNA, 24 bp, Artificial Sequence
  Description of Artificial Sequence:synthetic DNA
gtggcgtttgaaaccccggaagaa

SEQ ID NO: 7047 - DNA, 26 bp, Artificial Sequence
  Description of Artificial Sequence:synthetic DNA
tcggctagctaagtgaattagcagtc

SEQ ID NO: 7048 - DNA, 25 bp, Artificial Sequence
  Description of Artificial Sequence:synthetic DNA
atgactgaacaggaactgttgtctg

SEQ ID NO: 7049 - DNA, 25 bp, Artificial Sequence
  Description of Artificial Sequence:synthetic DNA
tgcttagttttttgctttgaactcg

SEQ ID NO: 7050 - DNA, 26 bp, Artificial Sequence
  Description of Artificial Sequence:synthetic DNA
atgtcaaacgttggaaagccacgtac

SEQ ID NO: 7051 - DNA, 28 bp, Artificial Sequence
  Description of Artificial Sequence:synthetic DNA
ctagttgtggaactggccttcttcagtg

SEQ ID NO: 7052 - DNA, 25 bp, Artificial Sequence
  Description of Artificial Sequence:synthetic DNA
atgaccaacatccgcgtagctatcg

SEQ ID NO: 7053 - DNA, 26 bp, Artificial Sequence
  Description of Artificial Sequence:synthetic DNA
ttagacgtcgcgtgcgatcagatcgt

SEQ ID NO: 7054 - DNA, 26 bp, Artificial Sequence
  Description of Artificial Sequence:synthetic DNA
atggcattggcacttgttttgaactc

SEQ ID NO: 7055 - DNA, 25 bp, Artificial Sequence
  Description of Artificial Sequence:synthetic DNA
ctaagcgaacttcaccgcgtaccta

SEQ ID NO: 7056 - DNA, 25 bp, Artificial Sequence
  Description of Artificial Sequence:synthetic DNA
atgagcgccgaactctttgaaaact

SEQ ID NO: 7057 - DNA, 25 bp, Artificial Sequence
  Description of Artificial Sequence:synthetic DNA
ttagctgcgtcctcctgcctgaatt

SEQ ID NO: 7058 - DNA, 25 bp, Artificial Sequence
  Description of Artificial Sequence:synthetic DNA
atggtgctgtctcccgctgacaaga

SEQ ID NO: 7059 - DNA, 25 bp, Artificial Sequence
  Description of Artificial Sequence:synthetic DNA
acgatatttggaggtcagcacggtg
